US012630838B2

(12) United States Patent
Layer et al.

(10) Patent No.: US 12,630,838 B2
(45) Date of Patent: May 19, 2026

(54) CELLS, TISSUES, ORGANS, AND ANIMALS HAVING ONE OR MORE MODIFIED GENES FOR ENHANCED XENOGRAFT SURVIVAL AND TOLERANCE

(71) Applicant: eGenesis, Inc., Cambridge, MA (US)

(72) Inventors: Jacob Layer, Cambridge, MA (US);
Wenning Qin, Cambridge, MA (US);
Yinan Kan, Cambridge, MA (US);
Juliet Crabtree, Cambridge, MA (US);
Michele Youd, Cambridge, MA (US);
David Heja, Cambridge, MA (US);
David Angeles Albores, Cambridge,
MA (US); Ranjith Anand, Cambridge,
MA (US); Paola Perrat, Cambridge,
MA (US); Russell Ernst, Cambridge,
MA (US); Violette Paragas,
Cambridge, MA (US)

(73) Assignee: eGenesis, Inc., Cambridge, MA (US)

( * ) Notice: Subject to any disclaimer, the term of this patent is extended or adjusted under 35 U.S.C. 154(b) by 382 days.

(21) Appl. No.: 18/327,565

(22) Filed: Jun. 1, 2023

(65) Prior Publication Data

US 2024/0084322 A1 Mar. 14, 2024

Related U.S. Application Data

(63) Continuation of application No. PCT/US2021/059265, filed on Nov. 12, 2021.

(Continued)

(51) Int. Cl.
*C12N 15/85* (2006.01)
*A01K 67/0276* (2024.01)
(Continued)

(52) U.S. Cl.
CPC .......... *C12N 15/85* (2013.01); *A01K 67/0276* (2013.01); *C07K 14/4747* (2013.01);
(Continued)

(58) Field of Classification Search
CPC .. C12N 15/85; C12N 9/0083; C12N 2830/20; C12N 2830/50; A01K 67/0276;
(Continued)

(56) References Cited

U.S. PATENT DOCUMENTS 6,039,784 A 3/2000 Luk
6,090,400 A 7/2000 Elliott
(Continued)

FOREIGN PATENT DOCUMENTS

CA 2534296 C 3/2013
CN 1972593 A 5/2007
(Continued)

OTHER PUBLICATIONS

Li H et al., "In vivo</i> Genome Editing Restores Haemostasis in a Mouse Model of Haemophilia" Nature, 475(7355): 217-221 (2011); doi:10.1038/nature 10177 (Year: 2011).*
(Continued)

*Primary Examiner* — Aaron J Kosar
(74) *Attorney, Agent, or Firm* — WILSON SONSINI GOODRICH & ROSATI

(57) ABSTRACT

The present disclosure relates to cells, tissues, organs, and/or animals having one or more modified genes for enhanced xenograft survival and/or tolerance. In addition, the present disclosure relates to methods of making and using the cells, tissues, organs, and/or animals having one or more of the modified genes.

39 Claims, 117 Drawing Sheets

Specification includes a Sequence Listing.

Related U.S. Application Data

(60) Provisional application No. 63/247,544, filed on Sep. 23, 2021, provisional application No. 63/218,080, filed on Jul. 2, 2021, provisional application No. 63/113,650, filed on Nov. 13, 2020.

(51) Int. Cl.

| | |
|---|---|
| *C07K 14/47* | (2006.01) |
| *C07K 14/705* | (2006.01) |
| *C07K 14/745* | (2006.01) |
| *C12N 9/02* | (2006.01) |

(52) U.S. Cl.
CPC .. *C07K 14/70503* (2013.01); *C07K 14/70596* (2013.01); *C07K 14/7455* (2013.01); *C12N 9/0083* (2013.01); *C12Y 114/99003* (2013.01); *A01K 2207/12* (2013.01); *A01K 2227/108* (2013.01); *A01K 2267/025* (2013.01); *C12N 2830/20* (2013.01); *C12N 2830/50* (2013.01)

(58) Field of Classification Search
CPC .......... A01K 2207/12; A01K 2227/108; A01K 2267/025; C07K 14/4747; C07K 14/70503; C07K 14/70596; C07K 14/7455; C12Y 114/99003
See application file for complete search history.

(56) References Cited

U.S. PATENT DOCUMENTS

| | | | |
|---|---|---|---|
| 6,331,658 | B1 | 12/2001 | Cooper et al. |
| 6,455,037 | B1 | 9/2002 | Ioannou et al. |
| 6,534,261 | B1 | 3/2003 | Cox, III et al. |
| 6,548,741 | B2 | 4/2003 | Desousa et al. |
| 6,586,240 | B1 | 7/2003 | Singer et al. |
| 6,867,347 | B2 | 3/2005 | Patience |
| 7,166,278 | B2 | 1/2007 | Zhu |
| 7,368,284 | B2 | 5/2008 | Koike |
| 7,485,769 | B2 | 2/2009 | Murakami et al. |
| 7,547,816 | B2 | 6/2009 | Day et al. |
| 7,795,493 | B2 | 9/2010 | Phelps et al. |
| 8,034,330 | B2 | 10/2011 | Zhu |
| 8,106,251 | B2 | 1/2012 | Ayares et al. |
| 8,142,769 | B2 | 3/2012 | Elliott et al. |
| 8,309,791 | B2 | 11/2012 | Fahrenkrug et al. |
| 8,697,359 | B1 | 4/2014 | Zhang |
| 8,785,718 | B2 | 7/2014 | Fahrenkrug et al. |
| 8,795,965 | B2 | 8/2014 | Zhang |
| 8,802,920 | B2 | 8/2014 | McQuillan et al. |
| 8,828,652 | B2 | 9/2014 | Varki et al. |
| 8,871,445 | B2 | 10/2014 | Cong et al. |
| 8,889,356 | B2 | 11/2014 | Zhang |
| 8,889,394 | B2 | 11/2014 | Chalasani |
| 8,906,616 | B2 | 12/2014 | Zhang et al. |
| 8,932,814 | B2 | 1/2015 | Cong et al. |
| 8,957,234 | B2 | 2/2015 | Kolel-Veetil et al. |
| 8,980,579 | B2 | 3/2015 | Mauro et al. |
| 8,993,233 | B2 | 3/2015 | Zhang et al. |
| 8,999,641 | B2 | 4/2015 | Zhang et al. |
| 9,023,649 | B2 | 5/2015 | Mali et al. |
| 9,090,708 | B2 | 7/2015 | Lechler et al. |
| 9,260,723 | B2 | 2/2016 | Mali et al. |
| 9,267,135 | B2 | 2/2016 | Church et al. |
| 9,339,519 | B2 * | 5/2016 | Ayares ............... C12N 15/8509 |
| 9,420,770 | B2 | 8/2016 | Tector, III et al. |
| 9,585,374 | B2 | 3/2017 | Wells et al. |
| 9,587,252 | B2 | 3/2017 | Church et al. |
| 9,642,899 | B2 | 5/2017 | McGregor et al. |
| 9,752,124 | B2 | 9/2017 | Sato et al. |
| 9,888,674 | B2 | 2/2018 | Tector |
| 9,889,207 | B2 | 2/2018 | Howard |
| 9,970,024 | B2 | 5/2018 | Church et al. |
| 9,999,641 | B2 | 6/2018 | Schneider et al. |
| 10,130,737 | B2 | 11/2018 | Ayares et al. |
| 10,183,978 | B2 | 1/2019 | Rogers et al. |
| 10,266,850 | B2 | 4/2019 | Doudna et al. |
| 10,273,501 | B2 | 4/2019 | Church et al. |
| 10,300,112 | B2 | 5/2019 | Ayares |
| 10,329,587 | B2 | 6/2019 | Church et al. |
| 10,375,938 | B2 | 8/2019 | Church et al. |
| 10,383,317 | B2 | 8/2019 | Ayares |
| 10,435,708 | B2 | 10/2019 | Mali et al. |
| 10,526,618 | B2 | 1/2020 | Esvelt et al. |
| 10,563,225 | B2 | 2/2020 | Church et al. |
| 10,640,789 | B2 | 5/2020 | Church et al. |
| 10,667,500 | B2 | 6/2020 | Tector |
| 10,717,990 | B2 | 7/2020 | Mali et al. |
| 10,736,903 | B2 | 8/2020 | Van Berkel et al. |
| 10,767,194 | B2 | 9/2020 | Church et al. |
| 10,787,684 | B2 | 9/2020 | Byrne et al. |
| 10,799,614 | B2 | 10/2020 | Holzer et al. |
| 10,851,380 | B2 | 12/2020 | Kim et al. |
| 10,925,263 | B2 | 2/2021 | Church et al. |
| 10,959,413 | B2 | 3/2021 | Church et al. |
| 10,968,276 | B2 | 4/2021 | Moore et al. |
| 11,064,684 | B2 | 7/2021 | Church et al. |
| 11,236,359 | B2 | 2/2022 | Mali et al. |
| 11,359,211 | B2 | 6/2022 | Church et al. |
| 11,365,429 | B2 | 6/2022 | Church et al. |
| 11,459,585 | B2 | 10/2022 | Church et al. |
| 11,512,325 | B2 | 11/2022 | Church et al. |
| 11,535,863 | B2 | 12/2022 | Church et al. |
| 11,649,469 | B2 | 5/2023 | Church et al. |
| 11,746,349 | B2 | 9/2023 | Church et al. |
| 11,981,917 | B2 | 5/2024 | Church et al. |
| 12,018,272 | B2 | 6/2024 | Church et al. |
| 12,058,986 | B2 * | 8/2024 | Yang ................. C12N 15/8778 |
| 2002/0010948 | A1 | 1/2002 | Patience |
| 2003/0082559 | A1 | 5/2003 | Beach et al. |
| 2003/0149254 | A1 | 8/2003 | Anderson et al. |
| 2005/0090046 | A1 | 4/2005 | So |
| 2005/0177882 | A1 | 8/2005 | Gavin et al. |
| 2005/0216964 | A1 | 9/2005 | Patience |
| 2005/0220796 | A1 | 10/2005 | Dynan et al. |
| 2005/0233994 | A1 | 10/2005 | Kaykas et al. |
| 2005/0266561 | A1 | 12/2005 | Wells |
| 2006/0107337 | A1 | 5/2006 | Cui et al. |
| 2007/0020725 | A1 | 1/2007 | Simmons et al. |
| 2009/0220455 | A1 | 9/2009 | Chilkoti |
| 2010/0076057 | A1 | 3/2010 | Sontheimer et al. |
| 2010/0093617 | A1 | 4/2010 | Barrangou et al. |
| 2011/0059502 | A1 | 3/2011 | Chalasani |
| 2011/0145940 | A1 | 6/2011 | Voytas et al. |
| 2011/0189776 | A1 | 8/2011 | Terns et al. |
| 2011/0223638 | A1 | 9/2011 | Wiedenheft et al. |
| 2011/0301073 | A1 | 12/2011 | Gregory et al. |
| 2011/0301341 | A1 | 12/2011 | Zhu |
| 2012/0025518 | A1 | 2/2012 | Kuranishi et al. |
| 2012/0058102 | A1 | 3/2012 | Wilson et al. |
| 2012/0060230 | A1 | 3/2012 | Collingwood et al. |
| 2012/0191082 | A1 | 7/2012 | Markowitz |
| 2013/0130248 | A1 | 5/2013 | Haurwitz et al. |
| 2013/0253040 | A1 | 9/2013 | Miller et al. |
| 2014/0017215 | A1 | 1/2014 | Ayares |
| 2014/0068797 | A1 | 3/2014 | Doudna et al. |
| 2014/0115728 | A1 | 4/2014 | Tector |
| 2014/0179006 | A1 | 6/2014 | Zhang |
| 2014/0179770 | A1 | 6/2014 | Zhang et al. |
| 2014/0242699 | A1 | 8/2014 | Zhang |
| 2014/0256046 | A1 | 9/2014 | Zhang et al. |
| 2014/0310830 | A1 | 10/2014 | Zhang et al. |
| 2014/0315985 | A1 | 10/2014 | May et al. |
| 2014/0335620 | A1 | 11/2014 | Zhang et al. |
| 2014/0342456 | A1 | 11/2014 | Mali et al. |
| 2014/0342457 | A1 | 11/2014 | Mali et al. |
| 2014/0356956 | A1 | 12/2014 | Church et al. |
| 2015/0031132 | A1 | 1/2015 | Church et al. |
| 2015/0031133 | A1 | 1/2015 | Church et al. |
| 2015/0106962 | A1 | 4/2015 | Sachs et al. |
| 2015/0166969 | A1 | 6/2015 | Takeuchi et al. |
| 2015/0232833 | A1 | 8/2015 | Mali et al. |
| 2015/0247150 | A1 | 9/2015 | Zhang et al. |
| 2015/0259704 | A1 | 9/2015 | Church et al. |

(56) References Cited

U.S. PATENT DOCUMENTS

| | | | |
|---|---|---|---|
| 2015/0284727 A1 | 10/2015 | Kim et al. |
| 2015/0291965 A1 | 10/2015 | Zhang et al. |
| 2015/0322457 A1 | 11/2015 | Kim et al. |
| 2016/0002670 A1 | 1/2016 | Church et al. |
| 2016/0017366 A1 | 1/2016 | Chen et al. |
| 2016/0153006 A1 | 6/2016 | Zhang et al. |
| 2016/0160210 A1 | 6/2016 | Mali et al. |
| 2016/0201089 A1 | 7/2016 | Gersbach et al. |
| 2016/0208243 A1 | 7/2016 | Zhang et al. |
| 2016/0237456 A1 | 8/2016 | Church et al. |
| 2016/0278350 A1 | 9/2016 | Ayares |
| 2016/0298134 A1 | 10/2016 | Chen et al. |
| 2016/0340662 A1 | 11/2016 | Zhang et al. |
| 2016/0355795 A1 | 12/2016 | Ran et al. |
| 2016/0355806 A1 | 12/2016 | Lee et al. |
| 2017/0191078 A1 | 7/2017 | Zhang et al. |
| 2017/0191082 A1 | 7/2017 | Chen et al. |
| 2017/0311579 A1 | 11/2017 | Tector, III |
| 2018/0073019 A1 | 3/2018 | Khalili |
| 2018/0153146 A1 | 6/2018 | Tector |
| 2018/0235194 A1 | 8/2018 | Fahrenkrug et al. |
| 2018/0249688 A1 | 9/2018 | Ayares et al. |
| 2018/0265848 A1 | 9/2018 | Kariko et al. |
| 2019/0076479 A1 | 3/2019 | Lin |
| 2019/0083542 A1 | 3/2019 | Lin |
| 2020/0228810 A1 | 7/2020 | Batard |
| 2020/0277631 A1 | 9/2020 | Doudna et al. |
| 2020/0299732 A1 | 9/2020 | Church et al. |
| 2020/0308599 A1 | 10/2020 | Church et al. |
| 2020/0318123 A1 | 10/2020 | Zhang |
| 2020/0404891 A1 | 12/2020 | Yang |
| 2021/0100225 A1 | 4/2021 | Church et al. |
| 2021/0222193 A1 | 7/2021 | Church et al. |
| 2022/0072200 A1 | 3/2022 | Ayares |
| 2022/0267805 A1 | 8/2022 | Yang et al. |
| 2022/0380811 A1 | 12/2022 | Church et al. |
| 2023/0056661 A1 | 2/2023 | Gao et al. |
| 2023/0244772 A1 | 8/2023 | Pillilli et al. |
| 2023/0295653 A1 | 9/2023 | Church et al. |
| 2024/0175057 A1 | 5/2024 | Church et al. |
| 2024/0294939 A1 | 9/2024 | Church et al. |

FOREIGN PATENT DOCUMENTS

| | | | |
|---|---|---|---|
| CN | 101160044 A | 4/2008 |
| CN | 102548394 A | 7/2012 |
| CN | 103397019 A | 11/2013 |
| CN | 105154471 A | 12/2015 |
| CN | 107249318 A | 10/2017 |
| CN | 108473963 A | 8/2018 |
| CN | 108486152 A | 9/2018 |
| CN | 110373389 A | 10/2019 |
| CN | 119120568 A | 12/2024 |
| EP | 1582591 A2 | 10/2005 |
| EP | 2077329 A1 | 7/2009 |
| JP | 2003523233 A | 8/2003 |
| JP | 2005515782 A | 6/2005 |
| JP | 2007501626 A | 2/2007 |
| JP | 2009136298 A | 6/2009 |
| JP | 2011207893 A | 10/2011 |
| JP | 2012516685 A | 7/2012 |
| JP | 2013501528 A | 1/2013 |
| JP | 2016500003 A | 1/2016 |
| JP | 2016502840 A | 2/2016 |
| JP | 2016504026 A | 2/2016 |
| JP | 2018500897 A | 1/2018 |
| JP | 2018518438 A | 7/2018 |
| JP | 2018530336 A | 10/2018 |
| JP | 2020517301 A | 6/2020 |
| JP | 2021097693 A | 7/2021 |
| JP | 7059468 B2 | 4/2022 |
| WO | WO-9528412 A1 | 10/1995 |
| WO | WO-9741863 A1 | 11/1997 |
| WO | WO-9903336 A1 | 1/1999 |
| WO | WO-9957266 A2 | 11/1999 |
| WO | WO-0192337 A2 | 12/2001 |
| WO | WO-0193908 A1 | 12/2001 |
| WO | WO-0232437 A1 | 4/2002 |
| WO | WO-2002067996 A2 | 9/2002 |
| WO | WO-02083838 A2 | 10/2002 |
| WO | WO-02086060 A2 | 10/2002 |
| WO | WO-03002746 A2 | 1/2003 |
| WO | WO-03055302 A1 | 7/2003 |
| WO | WO-2004016742 A2 | 2/2004 |
| WO | WO-2006110054 A1 | 10/2006 |
| WO | WO-2007024029 A1 | 3/2007 |
| WO | WO-2007033221 A2 | 3/2007 |
| WO | WO-2007053565 A2 | 5/2007 |
| WO | WO-2008108989 A2 | 9/2008 |
| WO | WO-2010001189 A1 | 1/2010 |
| WO | WO-2010051288 A1 | 5/2010 |
| WO | WO-2010054108 A2 | 5/2010 |
| WO | WO-2011007193 A1 | 1/2011 |
| WO | WO-2011020120 A2 | 2/2011 |
| WO | WO-2011068798 A1 | 6/2011 |
| WO | WO-2011139488 A2 | 11/2011 |
| WO | WO-2011143124 A2 | 11/2011 |
| WO | WO-2011146121 A1 | 11/2011 |
| WO | WO-2012087756 A1 | 6/2012 |
| WO | WO-2012112586 A1 | 8/2012 |
| WO | WO-2012138939 A1 | 10/2012 |
| WO | WO-2012164565 A1 | 12/2012 |
| WO | WO-2013098244 A1 | 7/2013 |
| WO | WO-2013126794 A1 | 8/2013 |
| WO | WO-2013141680 A1 | 9/2013 |
| WO | WO-2013142578 A1 | 9/2013 |
| WO | WO-2013148049 A1 | 10/2013 |
| WO | WO-2013169929 A1 | 11/2013 |
| WO | WO-2013176772 A1 | 11/2013 |
| WO | WO-2013188358 A1 | 12/2013 |
| WO | WO-2014022702 A2 | 2/2014 |
| WO | WO-2014065596 A1 | 5/2014 |
| WO | WO-2014066505 A1 | 5/2014 |
| WO | WO-2014089290 A1 | 6/2014 |
| WO | WO-2014093595 A1 | 6/2014 |
| WO | WO-2014093622 A2 | 6/2014 |
| WO | WO-2014093635 A1 | 6/2014 |
| WO | WO-2014093655 A2 | 6/2014 |
| WO | WO-2014093661 A2 | 6/2014 |
| WO | WO-2014093694 A1 | 6/2014 |
| WO | WO-2014093701 A1 | 6/2014 |
| WO | WO-2014093712 A1 | 6/2014 |
| WO | WO-2014093718 A1 | 6/2014 |
| WO | WO-2014099744 A1 | 6/2014 |
| WO | WO-2014099750 A2 | 6/2014 |
| WO | WO-2014138188 A1 | 9/2014 |
| WO | WO-2015006290 A1 | 1/2015 |
| WO | WO-2015013583 A2 | 1/2015 |
| WO | WO-2015031775 A1 | 3/2015 |
| WO | WO-2015089465 A1 | 6/2015 |
| WO | WO-2016065046 A1 | 4/2016 |
| WO | WO-2016094679 A1 | 6/2016 |
| WO | WO-2016154299 A1 | 9/2016 |
| WO | WO-2016187904 A1 | 12/2016 |
| WO | WO-2016197357 A1 | 12/2016 |
| WO | WO-2016197362 A1 | 12/2016 |
| WO | WO-2016205711 A1 | 12/2016 |
| WO | WO-2016210280 A1 | 12/2016 |
| WO | WO-2017044864 A1 | 3/2017 |
| WO | WO-2017062723 A1 | 4/2017 |
| WO | WO-2017109177 A1 | 6/2017 |
| WO | WO-2018144546 A1 | 8/2018 |
| WO | WO-2018156824 A1 | 8/2018 |
| WO | WO-2018195402 A1 | 10/2018 |
| WO | WO-2020228039 A1 | 11/2020 |
| WO | WO-2020228043 A1 | 11/2020 |
| WO | WO-2020228810 A1 | 11/2020 |
| WO | WO-2021072777 A1 | 4/2021 |
| WO | WO-2021072778 A1 | 4/2021 |

(56)          References Cited

FOREIGN PATENT DOCUMENTS

WO      WO-2021139722 A1     7/2021
WO      WO-2022104155 A1     5/2022

OTHER PUBLICATIONS

Mahfouz M, et al., "Targeted Transcriptional Repression Using a Chimeric TALE-SRDX Repressor Protein" Plant Mol Biol (2012; Published online: Dec. 14, 2011) 78:311-321; doi: 10.1007/s11103-011-9866-x (Year: 2011).*

Addgene adeno-associated viral (AAV) vector guide, p. 5, 1st paragraph, downloaded Nov. 5, 2025.

Aggarwal, Saloni. et al. Clinical translation of porcine islets for treating type 1 diabetes. Current Opinion in Endocrine and Metabolic Research 24 :100354, 1-6 (2022).

Doctors at MGB perform third successful pig kidney transplant. 7 NEWS Boston by Associated Press dated Sep. 8, 2025. Retrieved Sep. 25, 2025 from https://whdh.com/news/doctors-at-mgb-perform-third-successful-pig-kidney-transplant/.

Gornalusse et al., HLA-E-expressing pluripotent stem cells escape allogenic responses and lysis by NK cells. Nat Biotechnol. 35(8):765-772 (2017).

Hwang, Jinhee et al. The Lentiviral System Construction for Highly Expressed Porcine Stearoyl-CoA Desaturase-1 and Functional Characterization in Stably Transduced Porcine Swine Kidney Cells. Lipids 53(10): 933-945 (2018).

Jin, Qin et al. Genome editing pig models with elements for controllable gene expression. Animal Research and One Health 1(2):242-258 (2023).

Klymiuk et al., Genetic modification of pigs as organ donors for xenotransplantation. Mol. Reprod. Dev. 77(3):209-221 (2010).

Amendola, Mario. et al. Coordinate dual-gene transgenesis by lentiviral vectors carrying synthetic bidirectional promoters. Nature biotechnology 23(1):108-116 (2005).

Kulick, D M. et al. Transgenic swine lungs expressing human CD59 are protected from injury in a pig-to-human model of xenotransplantation. The Journal of thoracic and cardiovascular surgery 119(4 Pt 1):690-699 (2000).

Cho, et al. Targeted Genome Engineering In Human Cells With The Cas9 RNA-guided Endonuclease. Nature Biotechnology 31(3):230-232 (2013). With 11 Pages of Supplementary Material.

Close, Dan et al. Chapter 1: Expression of Non-native genes in a surrogate host organism. Genetic Engineering-Basics, New Applications and Responsibilities. :3-34 (2012).

PCTUS201375317 Figures as Originally Filed Dec. 16, 2013.

Elbashir, Sayda M. et al. Duplexes of 21-nucleotide RNAs mediate RNA interference in cultured mammalian cells. Nature 411(6836):494-498 (2001).

EP16183723.2 Decision of Revoking the European Patent dated Feb. 6, 2021.

EP20130863815 Summons to Attend Oral Proceedings dated Jan. 27, 2025.

EP3138910 Opposition Division Decision dated Jun. 2, 2021.

GenBank Accession No. NP_004039. Version No. NP_004039.1. beta-2-microglobulin precursor [*Homo sapiens*]: pp. 1-3. Record created May 7, 1999. Retrieved Feb. 7, 2025. Retrieved from: https://www.ncbi.nlm.nih.gov/protein/NP_004039.1.

GenBank Accession No. NP_005507. Version No. NP_005507.3. HLA class I histocompatibility antigen, alpha chain E precursor [*Homo sapiens*]: pp. 1-4. Record created Apr. 27, 2005. Retrieved Feb. 7, 2025. Retrieved from: https://www.ncbi.nlm.nih.gov/protein/NP_005507.3.

Goldberg, Alfred L. Protein degradation and protection against misfolded or damaged proteins. Nature 426(6968):895-899 (2003).

Hagedorn, Claudia. et al. Genomic cis-acting Sequences Improve Expression and Establishment of a Nonviral Vector. Molecular Therapy-Nucleic Acids 2(8):1-9 (2013).

Hatfull, Graham F. Bacteriophage genomics. Current Opinion in Microbiology 11(5):447-453 (2008).

Henrich, Michael, and Keith J Buckler. Effects of anoxia, aglycemia, and acidosis on cytosolic Mg2+, ATP, and pH in rat sensory neurons. American journal of physiology 294(1):C280-C294 (2008). Published online Oct. 31, 2007.

Hwang, et al. Efficient genome editing in zebrafish using a CRISPR-Cas system. Nature Biotechnology 31:227-229 (2013), and 21 pages of Supplementary Materials.

Jenuwein, Thomas. et al. The immunoglobulin mu enhancer core establishes local factor access in nuclear chromatin independent of transcriptional stimulation. Genes & development 7(10):2016-2032 (1993).

Jin, Dong II. et al. Gene Targeting of Porcine Endogenous Retrovirus Locus in Pig Fetal Fibroblast Cells. Biology of Reproduction 81(1_Suppl):625 (2009).

Jinek, et al. A programmable Dual-RNA-Guided DNA endonuclease in adaptive bacterial immunity. Science 337:6096, 816-821 (2012). With 37 pages of Supplementary Materials.

Karpala, Adam J. et al. Immune responses to dsRNA: implications for gene silencing technologies. Immunology and cell biology 83(3):211-216 (2005).

Koseki, S. et al. Factors governing the activity in vivo of ribozymes transcribed by RNA polymerase III. Journal of virology 73(3):1868-1877 (1999).

Kwon, Dae-Jin. et al. Generation of alpha-1, 3-galactosyltransferase knocked-out transgenic cloned pigs with knocked-in five human genes. Transgenic Research 26(1):153-163 (2017).

Lander, Eric S. et al. Initial Sequencing and Analysis of the Human Genome. Nature 409(6822):860-921 (2001).

Lebreton F. et al., Insulin-producing organoids engineered from islet and amniotic epithelial cells to treat diabetes. Nature Communications, vol. 10, No. 1, 4491, doi: 10.1038/s41467-019-12472-3 (2019).

Letter and replacement drawings submitted in International application No. PCT/US2013/075317 on Mar. 5, 2014.

Loonstra, A. et al. Growth inhibition and DNA damage induced by Cre recombinase in mammalian cells. Proceedings of the National Academy of Sciences of the United States of America 98(16):9209-9214 (2001).

Makrides, Table 1—Virus-based vectors for gene delivery and expression in mammalian cells from Gene Transfer and Expression in Mammalian Cells. Elsevier: (2003).

Mali et al., RNA-guided human genome engineering via Cas9. Science 339:823-826 (2013) and Supplementary pages.

McCall, Kimberly, and W Bender. Probes of chromatin accessibility in the Drosophila bithorax complex respond differently to Polycomb-mediated repression. The EMBO journal 15(3):569-580 (1996).

McShan et al., "Complete genome sequence of an M1 strain of Streptococcus pyogenes," PNAS, vol. 98, No. 8, Apr. 10, 2001, pp. 4658-4663.

McShan, Michael W. et al. Genome sequence of a nephritogenic and highly transformable M49 strain of Streptococcus pyogenes. Journal of bacteriology 190(23):7773-7785 (2008).

O'Neill, Timothy E. et al. Nucleosome arrays inhibit both initiation and elongation of transcripts by bacteriophage T7 Rna polymerase. Journal of molecular biology 223(1):67-78 (1992).

PCT/US2013/075317 Invitation to correct defects in International application dated Jan. 9, 2014.

Rabuka, David. et al. Genomics Redux. Catalyst 9(1):1-32 (2014).

Romani, Andrea M.P. Cellular magnesium homeostasis. Archives of biochemistry and biophysics 512(1):1-23 (2011).

Sanders, Robert. Cheap and easy technique to snip DNA could revolutionize gene therapy. berkeley news, Jan. 7, 2013; [retrieved on Feb. 20, 2025]. Available at URL:https://news.berkeley.edu/2013/01/07/cheap-and-easy-technique-to-snip-dna-could-revolutionize-gene-therapy/ pp. 1-7.

Starega-Roslan, Julia. et al. The role of the precursor structure in the biogenesis of microRNA. Cellular and molecular life sciences 68(17):2859-2871 (2011).

Summons to attend oral proceedings in connection with EP2825654 dated Oct. 24, 2019, and preliminary opinion of the opposition division annexed thereto.

U.S. Appl. No. 61/652,086, inventors Martin; Jinek et al., filed May 25, 2012.

(56)      References Cited

OTHER PUBLICATIONS

U.S. Appl. No. 61/716,256, inventor Martin; Jinek, filed Oct. 19, 2012.

U.S. Appl. No. 61/717,324, inventors Seung; Woo Kim et al., filed Oct. 23, 2012.

U.S. Appl. No. 61/734,256, inventors Fuqiang; Chen et al., filed Dec. 6, 2012.

U.S. Appl. No. 61/736,527, inventors Feng; Zhang et al., filed Dec. 12, 2012.

U.S. Appl. No. 61/738,355, inventor George; M. Church, filed Dec. 17, 2012.

U.S. Appl. No. 61/748,427, inventors Zhang; Feng et al., filed Jan. 2, 2013.

U.S. Appl. No. 61/779,169, inventor Prashant; Mali, filed Mar. 13, 2013.

U.S. Appl. No. 61/835,931, inventors Feng; Zhang et al., filed Jun. 17, 2013.

Wiedenheft, et al. RNA-guided genetic silencing systems in bacteria and archaea. Nature 482:331-338 (2012).

Wikipedia entry for TALENS dated Nov. 16, 2012.

Wostenberg, Christopher. et al. The role of human Dicer-dsRBD in processing small regulatory RNAs. PloS one 7(12):e51829, 1-12 (2012).

Xu, Tingting. et al. Expression of a Humanized viral 2A-mediated lux operon efficiently generates autonomous bioluminescence in human cells. PloS One 9(5):e96347, 1-11 (2014).

Yang, Jr-Shiuan. et al. Functional parameters of Dicer-independent microRNA biogenesis. RNA 18(5):945-957 (2012).

Zhou, Huanbin. et al. Large chromosomal deletions and heritable small genetic changes induced by CRISPR/Cas9 in rice. Nucleic acids research 42(17):10903-10914 (2014).

Zhou, Xiaoqing. et al. Generation of CRISPR/Cas9-mediated gene-targeted pigs via somatic cell nuclear transfer. Cellular and molecular life sciences 72(6):1175-1184 (2015). Published online Oct. 2, 2014.

Ahlborg, H.G. et al., "Bone Loss and Bone Size after Menopause," N Engl J Med., 2003;349(4):327-334.

Aigner et al., "Transgenic pigs as models for translational biomedical research." J. Mol. Med., 2010;88:653-664.

Angstrom et al., "Structural characterization of alpha1,3-galactosyltransferase knockout pig heart and kidney glycolipids and their reactivity with human and baboon antibodies," Xenotransplantation, 2010;17:48-60.

Araki et al., "Comparative analysis of right element mutant lox sites on recombination efficiency in embryonic stem cells." BMC Biotechnology, 2010;10:29.

Araki et al., "Targeted integration of DNA using mutant lox sites in embryonic stem cells." Nucleic Acids Res., 1997;25:868-872.

Armstrong, J.A. et al., "C-type Virus Particles in Pig Kidney Cell Lines," J Gen Virol., 1971;10(2):195-198.

Baertschiger, R.M. et al., "Absence of humoral and cellular alloreactivity in baboons sensitized to pig antigens," Xenotransplantation, 2004;11(1):27-32.

Belsham et al., "A region of the 5' noncoding region of foot-and-mouth disease virus RNA directs efficient internal initiation of protein synthesis within cells: involvement with the role of L protease in translational control." J Virol, 1990;64:5389-5395.

Buermann et al., "Pigs expressing the human inhibitory ligand PD-L1 (Cd 274) provide a new source of xenogeneic cells and tissues with low immunogenic properties." Xenotransplantation, 2018;25(5): e12387.

Burlak et al., "N-linked glycan profiling of GGTA 1/CMAH knock-out pigs identifies new potential carbohydrate xenoantigens." Xenotransplantation, 2013;20(5):277-291.

Butler et al., "Recent advances in genome editing and creation of genetically modified pigs," International Journal of Surgery, 2015;23(B):217-222.

Byrne et al., "B4GALNT2 and xenotransplantation: A newly appreciated xenogeneic antigen." Xenotransplantation, 2013;e12394.

Byrne, G.W. et al., "Cloning and expression of porcine b1,4 N-acetylgalactosaminyl transferase encoding a new xenoreactive antigen," Xenotransplantation, 2014;21(6):543-554.

Campbell et al., "Sheep cloned by nuclear transfer from a cultured cell line." Nature, 1996;380:64-66.

Chen et al., "Inhibition of intravascular thrombosis in murine endotoxemia by targeted expression of hirudin and tissue factor pathway inhibitor analogs to activated endothelium." Blood, 2004;104:1344-1349.

Chui et al., "Alpha-Mannosidase-II Deficiency Results in Dyserythropoiesis and Unveils an Alternate Pathway in Oligosaccharide Biosynthesis." Cell, 1997;90:157-167.

Chui et al., "Genetic remodeling of protein glycosylation in vivo induces autoimmune disease." PNAS, 2001;98(3):1142-1147.

Chung H., et al., "Inhibition of Porcine Endogenous Retrovirus in PK15 Cell Line by Efficient Multitargeting RNA Interference," Transplant International, 2013;27(1):96-105.

Chung, J.H. et al., "Characterization of the chicken beta-globin insulator", PNAS, 1997;94(2):575-80.

Cibelli, J.B. et al., "Cloned transgenic calves produced from nonquiescent fetal fibroblasts," Science, 1998;280(5367):1256-1258.

Clemenceau, B. et al., "Microchimerism and transmission of porcine endogenous retrovirus from a pig cell line or specific pathogen-free pig islets to mouse tissues and human cells during xenografts in nude mice," Diabetologia, 2002;45(6):914-923.

Cooper, D. et al., "The Potential of Genetically-Engineered Pigs in Providing in Alternative Source of Organs and Cells for Transplantation," J Biomed Res., 2013;27(4):249-253.

Cooper, D.K.C. et al., "Alloantibody and xenoantibody cross-reactivity in transplantation," Transplantation, 2004;77(1):1-5.

Cooper, D.K.C. et al., "Immunobiological Barriers to Xenotransplantation," Int J Surg., 2015;23(Pt B):211-216.

Cooper et al., "Progress in Pig-To-Nonhuman Primate Transplantation Models (1998-2013): A Comprehensive Review of the Literature." Xenotransplantation, 2014;21(5):397-419.

Cooper et al., "The role of genetically engineered pigs in xenotransplantation research." The Journal of pathology, 2016;238(2):288-99.

Cowan, P.J. et al., "Kidney Xenotransplantation," Kidney Int., 2014;85(2):265-275.

Crew et al., "An HLA-E single chain trimer inhibits human NK cell reactivity towards porcine cells." Molecular Immunology, 2005;42:1205-1214.

Dall'Olio et al., "The expanding roles of the Sda/Cad carbohydrate antigen and its cognate glycosyltransferase B4GALNT2." Biochimica et Biophysica Acta (BBA)—General Subjects. 2014;1840(1):443-53.

Davis, A.E. et al., "Changes in geographic disparity in kidney transplantation since the final rule," Transplantation, 2014;98(9):931-936.

Denner, J., "Elimination of porcine endogenous retroviruses from pig cells." Xenotransplantation, 2015;411-412.

Denner, J., "How Active Are Porcine Endogenous Retroviruses (PERVs)?" Viruses, 2016, vol. 8, No. 215, pp. 1-11.

Dicarlo et al., "Genome engineering in *Saccharomyces cerevisiae* using CRISPR-Cas systems." Nucleic acids research, 2013;41(7):4336-4343.

Dieckhoff et al., "Knockdown of porcine endogenous retrovirus (PERV) expression by PERV-specific sh RNA in transgenic pigs." Xenotransplantation, 2008;15(1):36-45.

Donati-Bourne, J. et al., "Donor-Recipient Size Mismatch in Paediatric Renal Transplantation," J Transplant, 2014;204:317574.

Eggers, P.W., "Mortality Rates Among Dialysis Patients in Medicare's End-Stage Renal Disease Program," Am J Kidney Dis., 1990;15(5):414-421.

Ekser, B. et al., "Progress toward clinical xenotransplantation," Int J Surg., 2015;23(Pt B):197-198.

Ericsson et al., "Identification of Novel Porcine Endogenous Betaretrovirus Sequences in Miniature Swine," Journal of Virology, 2001;75(6):2765-2770.

(56)         References Cited

OTHER PUBLICATIONS

Estrada et al., "Evaluation of human and nonhuman primate antibody binding to pig cells lacking GGTA 1/CMAH/4Gal NT 2 genes." Xenotransplantation, 2015;22(3):194-202.

Fang et al., "The sequence and analysis of a Chinese pig genome." GigaScience. 2012;1(16):1-11.

FDA Guidance for Industry: Gene Therapy Clinical Trials—Observing Subjects for Delayed Adverse Events (Nov. 2006).

FDA Guidance for Industry: Source Animal, Product, Preclinical, and Clinical Issues Concerning the Use of Xenotransplantation Products in Humans (Apr. 2003, revised Dec. 2016).

FDA Guidance: Preclinical Assessment of Investigational Cellular and Gene Therapy Products (Nov. 2013).

Fiebig, U. et al., "Neutralizing antibodies against conserved domains of p15E of porcine endogenous retroviruses: basis for a vaccine for xenotransplantation?" Virology, 2003;307(2):406-413.

Fischer, K. et al., "Efficient production of multi-modified pigs for xenotransplantation by 'combineering', gene stacking and gene editing," Sci Rep., 2016;6:29081.

Fishman J.A., "Prevention of Infection in Xenotransplantation: Designated Pathogen-Free Swine in the Safety Equation," Xenotransplantation, 2020;27(3):e12595.

Gardiner-Garden, M. et al., "CpG islands in vertebrate genomes," J Mol Bio., 1987; 196(2):261-82.

Gietz et al., "High-efficiency yeast transformation using the LiAc/SS carrier DNA/PEG method." Nat Protoc, 2007;2(1):31-34.

Gourishankar, S. et al., "The Stability of the Glomerular Filtration Rate after Renal Transplantation Is Improving," J Am Soc Nephrol., 2003;14(9):2387-2394.

Grams, M.E. et al., "Recipient age and time spent hospitalized in the year before and after kidney transplantation," Transplantation, 2012;94(7):750-756.

Guell et al., "PERV inactivation is necessary to guarantee absence of pig-to-patient PERVs transmission in xenotransplantation." Xenotransplantation, 2017;24:e12366.

Haberle, V. et al., "Eukaryotic core promoters and the functional basis of transcription initiation," Nat Rev Mol Cell Biol., 2018;19(10):621-637.

Hai et al., "One-step generation of knockout pigs by zygote injection of CRISPR/Cas system." Cell Research, 2014;24:372-375.

Higginbotham, L. et al., "Pre-transplant antibody screening and anti-CD154 costimulation blockade promote long-term xenograft survival in a pig-to-primate kidney transplant model," Xenotransplantation, 2015;22(3):221-230.

Hotta et al., "Long-term nonhuman primate renal allograft survival without ongoing immunosuppression in recipients of delayed donor bone marrow transplantation." Transplantation, 2018;102(4):e128-e136.

Hryhorowicz, M. et al., "Genetically Modified Pigs as Organ Donors for Xenotransplantation," Mol. Biotechnol., 2017, vol. 59, pp. 435-444.

Hsu, P.D. et al., "Development and Applications of CRISPR-Cas9 for Genome Engineering," Cell, 2014;157(6):1262-1278.

Hwang, S. et al., "Production of cloned Korean native pig by somatic cell nuclear transfer," Dev Reprod., 2015, vol. 19, No. 2, pp. 79-84.

Ide, K. et al., "Role for CD47-SIRPa signaling in xenograft rejection by macrophages," PNAS, 2007;104:5062-5066.

International Preliminary Report on Patentability issued in PCT/US2021/059265, dated May 16, 2023.

International Search Report and Written Opinion for International Application No. PCT/CN2019/087310, mailed May 8, 2020, 16 pages.

International Search Report and Written Opinion for PCT/CN2019/087314 mailed Feb. 2, 2020.

International Search Report and Written Opinion for PCT/CN2019/112038 mailed Jul. 21, 2020.

International Search Report and Written Opinion for PCT/CN2019/112039 mailed Jul. 21, 2020.

International Search Report and Written Opinion for PCT/CN2020/090440 mailed Aug. 19, 2020.

International Search Report and Written Opinion for PCT/US2013/075317 mailed Apr. 15, 2014.

International Search Report and Written Opinion for PCT/US2013/075326 mailed Aug. 22, 2014.

International Search Report and Written Opinion for PCT/US2014/045691 mailed Nov. 7, 2014.

International Search Report and Written Opinion for PCT/US2014/048140 mailed Jan. 23, 2015.

International Search Report and Written Opinion for PCT/US2016/055916 mailed Dec. 30, 2016.

International Search Report and Written Opinion for PCT/US2018/016152 mailed Jun. 21, 2018.

International Search Report and Written Opinion for PCT/US2018/019313 mailed May 30, 2018.

International Search Report and Written Opinion for PCT/US2018/028539 mailed Jul. 9, 2018.

International Search Report and Written Opinion issued in PCT/US2021/059265, mailed Apr. 1, 2022.

Iwase, H. et al., "Current status of pig kidney xenotransplantation," Int J Surg., 2015;23(Pt B):229-233.

Iwase, H. et al., "Pig kidney graft survival in a baboon for 136 days: longest life-supporting organ graft survival to date," Xenotransplantation, 2015;22(4):302-309.

Kaminski et al., "Crispr/Cas9 gene editing eradicates latent and protects cells against new HIV-1 infection," Journal of the International AIDS Society, 2015;18(Supp. SUPPL. 4):33, Abstract No. TUAA0203.

Karlas et al., "Inhibition of porcine endogenous retroviruses by RNA interference: increasing the safety of xenotransplantation." Virology, 2004;325(1):18-23.

Kasiske, B.L. et al., "A simple tool to predict outcomes after kidney transplant," Am J Kidney Dis., 2010;56(5):947-960.

Kaufman et al., "Improved vectors for stable expression of foreign genes in mammalian cells by use of the untranslated leader sequence from EMC virus." Nucleic Acids Res., 1991;19:4485-4490.

Kemter et al., "Will genetic engineering carry xenotransplantation of pig islets to the clinic ?." Current Diabetes Reports, 2018;18(11);1-12.

Kim, E. et al., "An Improved System for Generation of Diploid Cloned Porcine Embryos Using Induced Pluripotent Stem Cells Synchronized to Metaphase," PLoS One, 2016;11(7):e0160289.

Kim et al., "High Cleavage Efficiency of a 2A Peptide Derived from Porcine Teschovirus 1 in Human Cell Lines, Zebrafish and Mice," PLoS One, 2011;6(4):e18556.

Kim et al., "Long-Term Survival of Pig-to-Rhesus Macaque Renal Xenografts is Dependent on CD4 T cell Depletion." Am J Transplant, 2019;19(8):2174-2185.

Kim, S. et al., "Highly efficient RNA-guided genome editing in human cells via delivery of purified Cas9 ribonucleoproteins," Genome Res., 2014;24(6):1012-1019.

Kim, W.R. et al., "OPTN/SRTR 2015 Annual Data Report: Liver," Am J Transplant., 2017;17 Suppl 1:174-251.

Klymiuk et al., "Phylogeny, recombination and expression of porcine endogenous retrovirus 2 nucleotide sequences." Journal of general virology, 2006;87(4):977-86.

Lai, L. et al., "Production of alpha-1,3-galactosyltransferase knockout pigs by nuclear transfer cloning," Science, 2002;295(5557):1089-1092.

Larsen, C., et al., "Rational development of LEA29Y a High-Affinity Variant of CTLA4-Ig with Potent Immunosuppressive Properties," Am. I Transplant, 2005;5:443-453.

Leberfinger et al. (2019). "Bioprinting functional tissues." Acta Biomaterialia. 95:32-49.

Lee, D. et al., "Rapid Determination of Perv Copy Number From Porcine Genomic DNA by Real-Time Polymerase Chain Reaction," Anim Biotechnol., 2011;22(4):175-180.

Lee et al., "Complete humanization of the mouse immunoglobulin loci enables efficient therapeutic antibody discovery." Nat Biotechnol., 2014;32:356-363.

(56) References Cited

OTHER PUBLICATIONS

Lee, G.S et al., "Effect of epidermal growth factor in preimplantation development of porcine cloned embryos," Mol. Reprod. Develop., 2005, vol. 71, pp. 45-51.

Levey, A.S. et al., "The definition, classification, and prognosis of chronic kidney disease: a KDIGO Controversies Conference report," Kidney International, 2011;80(1):17-28.

Levitt, "Definition of an efficient synthetic poly(A) site", Genes & Development, 1989;3:1019-1025.

Li et al., "Knockdown of Porcine Endogenous Retroviruses by RNA Interference in Chinese Experimental Miniature Pig Fibroblasts, " Transplantation Proceedings, 2013;45(2):748-755.

Lilienfeld, B.G. et al., "Transgenic expression of HLA-E single chain trimer protects porcine endothelial cells against human natural killer cell-mediated cytotoxicity," Xenotransplantation, 2007;14(2):126-134.

Liu, Z. et al., "Systematic comparison of 2A peptides for cloning multi-genes in a polycistronic vector," Scientific Reports, 2017;7(2193).

Loveland, B.E. et al., "Characterization of a CD46 transgenic pig and protection of transgenic kidneys against hyperacute rejection in non-immunosuppressed baboons," Xenotransplantation, 2009;11(2):171-183.

Lutz, A.J. et al., "Double knockout pigs deficient in N-glycolylneuraminic acid and galactose α-1,3-galactose reduce the humoral barrier to xenotransplantation," Xenotransplantation, 2013;20(1):27-35.

Maizels, N., "Genome Engineering with Cre-loxP," J Immunol., 2013;191(1).

Mali., et al., "RNA-Guided Human Genome Engineering via Cas9," Science, 2013;339(6121):823-826.

Marcen, R. et al., "Long-term graft function changes in kidney transplant recipients," NDT Plus, 2010;3(Suppl_2):ii2-ii8.

Martens, G.R. et al., "Humoral Reactivity of Renal Transplant-Waitlisted Patients to Cells From GGTA1/CMAH/B4GaINT2, and SLA Class I Knockout Pigs," Transplantation, 2017;101(4):e86-e92.

McGregor, C.G.A. et al., "Human CD55 expression blocks hyperacute rejection and restricts complement activation in Gal knockout cardiac xenografts," Transplantation, 2012;93(7):686-692.

Mcgregor C.G.A., et al., "PERVading Strategies and Infectious Risk for Clinical Xenotransplantation," Xenotransplantation, 2018;25(4)e12402.

Merry et al., "Glycoscience finally comes of age." EMBO reports, 2005;6(10):900-903.

Moalic, Y. et al., "Porcine Endogenous Retrovirus Integration Sites in the Human Genome: Features in Common with Those of Murine Leukemia Virus," J Virol., 2006;80(22):10980-10988.

Mohiuddin, M.M. et al., "Chimeric 2010R4 anti-CD40 antibody therapy is critical for long-term survival of GTKO.hCD46.hTBM pig-to-primate cardiac xenograft," Nat Commun., 2016;7:11138.

Mohlke et al., "Mvwf, a dominant modifier of murine von Willebrand factor, results from altered lineage-specific expression of a glycosyltransferase." Cell, 1999;96:111-120.

Mulder et al., "Human CD46 aberrant splicing in transgenic mice." Gene, 1997; 186:83-86.

Muller-Kuller et al., "A minimal ubiquitous chromatin opening element (UCOE) effectively prevents silencing of juxtaposed heterologous promoters by epigenetic remodeling in multipotent and pluripotent stem cells." Nucleic Acids Research, 2015;43:1577-1592.

Neville, J.J. et al., "Ubiquitous Chromatin-opening Elements (UCOEs): Applications in biomanufacturing and gene therapy," Biotechnology Advances, 2017;35:557-564.

Niu, D. et al., "Inactivation of porcine endogenous retrovirus in pigs using CRISPR-Cas9," Science, 2017, vol. 357, No. 6357, pp. 1303-1307.

Niwa et al., "Efficient selection for high-expression transfectants with a novel eukaryotic vector." Gene, 1991;108:193-199.

Nojima, T. et al., "Definition of RNA Polymerase II CoTC Terminator Elements in the Human Genome," Cell Reports, 2013;3(4):1080-1092.

Nonaka et al., "Determination of carbohydrate structure recognized by prostate-specific F77 monoclonal antibody through expression analysis of glycosyltransferase genes." The Journal of Biological Chemistry, 2014;289(23):16478-16486.

Ojo, A.O. et al., "The impact of simultaneous pancreas-kidney transplantation on long-term patient survival," Transplantation, 2001;71(1):82-90.

Patience, C. et al., "Infection of human cells by an endogenous retrovirus of pigs," Nat Med., 1997;3(3):282-286.

Patience, C. et al., "Multiple Groups of Novel Retroviral Genomes in Pigs and Related Species," J Virol., 2001;75(6):2771-2775.

PCT/CN2019/112038, International Preliminary Report on Patentability mailed Apr. 19, 2022, 5 pages.

PCT/CN2020/090440, International Preliminary Report on Patentability mailed Nov. 16, 2021, 7 pages.

PCT/CN2021/070659, International Search Report and Written Opinion mailed Apr. 6, 2021, 10 pages.

PCT/US2018/028539, International Preliminary Report on Patentability mailed Oct. 22, 2019, 11 pages.

Pelletier et al., "Internal initiation of translation of eukaryotic mRNA directed by a sequence derived from poliovirus RNA." Nature, 1988;334:320-325.

Pinheiro, L.B. et al., "Evaluation of a droplet digital polymerase chain reaction format for DNA copy number quantification," Anal Chem., 2012;84(2):1003-1011.

Ramakrishnan et al., "The Adipose Stromal Vascular Fraction as a Complex Cellular Source for Tissue Engineering Applications." Tissue Engineering, Part B, 2018;4(4):289-299.

Ramsoondar, J. et al., "Production of transgenic pigs that express porcine endogenous retrovirus small interfering RNAs," Xenotransplantation, 2009;16(3):164-180.

Reyes, L.M. et al., "Creating class I MHC-null pigs using guide RNA and the Cas9 endonuclease," J Immunol., 2014;193(11):5751-5757.

Reynders et al., "How Golgi glycosylation meets and needs trafficking: the case of the COG complex." Glycobiology, 2011;21 (7): 853-863.

Sato et al. (2019). "Recent advance in genome editing-based gene modification in pigs." Reproductive Biology and Technology in Animals, 2019:1-36.

Sato et al., "Direct injection of CRISPR/Cas9-related mRNA into cytoplasm of parthenogenetically activated porcine oocytes causes frequent mosaicism for indel mutations." Int. J. Mol. Sci., 2015;16:17838-17856.

Schuurman, H.J., "The International Xenotransplantation Association consensus statement on conditions for undertaking clinical trials of porcine islet products in type 1 diabetes—chapter 2: Source pigs," Xenotransplantation, 2009;16(4):215-222.

Semaan, M. et al., "Cytotoxic Effects during Knock Out of Multiple Porcine Endogenous Retrovirus (PERV) Sequences in the Pig Genome by Zinc Finger Nucleases (ZFN)," PLoS One, 2015;10(4):e0122059.

Semaan, M. et al., "Long-term effects of PERV-specific RNA interference in transgenic pigs," Xenotransplantation, 2012;19(2):112-121.

Sharma, P. et al., "Does stage-3 chronic kidney disease matter?: A systematic literature review," British Journal of General Practice, 2010;60(575):e266-e276.

Shen, Z. et al., "Immunoregulation Effect by Overexpression of Heme Oxygenase-1 on Cardiac Xenotransplantation," Transplant Proc., 2011;43(5):1994-1997.

Starzl, T.E. et al., "Cell Migration and Chimerism After Whole-organ Transplantation: The Basis of Graft Acceptance," Hepatology, 1993;17(6):1127-1152.

Starzl, T.E. et al., "Renal Heterotransplantation From Baboon To Man: Experience With 6 Cases," Transplantation, 1964;2:752-756.

Suzuki, K. et al., "In vivo genome editing via CRISPR/Cas9 mediated homologyindependent targeted integration," Nature, 2016;540(7631):144-149.

(56)　　　　　References Cited

OTHER PUBLICATIONS

Tanabe, T. et al., "Role of Intrinsic (Graft) Versus Extrinsic (Host) Factors in the Growth of Transplanted Organs Following Allogeneic and Xenogeneic Transplantation," Am J Transplant., 2017;17(7):1778-1790.

Tseng, Y. et al., "Elicited antibodies in baboons exposed to tissues from alpha1,3-galactosyltransferase gene-knockout pigs," Transplantation, 2006;81(7):1058-1062.

Vagefi, P. et al., "Progress towards inducing tolerance of pig-to-primate xenografts," Int J Surg., 2015;23(Pt B):291-295.

Van't Veer, C. et al., "Inhibitory Mechanism of the Protein C Pathway on Tissue Factor-induced Thrombin Generation: Synergistic Effect in Combination With Tissue Factor Pathway Inhibitor," J Biol Chem., 1997;272(12):7983-7994.

Wang et al., "Eliminating xenoantigen expression on swine RBC." Transplantation, 2017;101(3): 517-523.

Wang, Y. et al., "Efficient generation of B2m-null pigs via injection of zygote with TALENs," Sci Rep., 2016;6:38854.

Weiss et al., "HLA-E/human 2-microglobulin transgenic pigs: protection against xenogeneic human anti-pig natural killer cell cytotoxicity." Transplantation, 2009;87(1):35-43.

Wolf-van Buerck, L. et al., "LEA29Y expression in transgenic neonatal porcine islet-like cluster promotes long-lasting xenograft survival in humanized mice without immunosuppressive therapy," Scientific Reports, 2017;7:3572.

Yang, L. et al., "Genome-wide inactivation of porcine endogenous retroviruses (PERVs)," Science, 2015, vol. 350, No. 6264 pp. 1101-1104.

Yang, L. et al., "Optimization of scarless human stem cell genome editing," Nucleic Acids Res., 2013;41(19):9049-9061.

Ye, Y. et al., "Secondary Organ Allografting After a Primary "Bridging" Xenotransplant," Transplantation, 1995;60(1):19-22.

Zhang et al., "Three-Dimensional Bioprinting Strategies for Tissue Engineering," Cold Spring Harbor Perspectives in Medicine, 2018;8(2):a025718.

Zhao, Z. et al., "CpG islands: algorithms and applications in methylation studies," Biochem Biophys Res Commun., 2009;382(4):643-645.

Zheng et al., "Efficient and Safe Editing of Porcine Endogenous Retrovirus Genomes by Multiple-Site Base-Editing Editor." Cells, 2022;11:3975.

Zou et al., "Selective germline genome edited pigs and their long immune tolerance in Non-Human Primates." bioRxiv preprint, 2020.

Anand et al., Design and testing of a humanized porcine donor for xenotransplantation. Nature, vol. 622, pp. 393-401 (2023).

Niu et al., Porcine Genome Engineering for Xenotransplantation. Advanced Drug Reviews, vol. 168, pp. 229-245 (2021).

Smith Jr, et al., Robust, Persistent Transgene Expression in Human Embryonic Stem Cells is Achieved With AAVS1-targeted Integration. Stem Cells 26(2):496-504 (2008).

Yue et al., Extensive Germline Genome Engineering in Pigs. Nature Biomedical Engineering, vol. 5, pp. 134-143 (2020).

Yung et al., Xenotransplantation: where do we stand in 2016? Swiss Medical Weekly, vol. 147, No. 0506, pp. 1-17 (2017).

Abouna GM, Organ Shortage Crisis: Problems and Possible Solutions. Transplant Proc. 40(1):34-38 doi:10.1016/j.transproceed.2007.11.067 (2008).

Acute Liver Failure: Symptoms and Causes. Mayo Clinic Oct. 15, 2024. Retrieved Jan. 28, 2026 from URL: https://www.mayoclinic.org/diseases-conditions/acute-liver failure/symptoms-causes/syc-20352863, 11 pages.

Boeke et al. The Genome Project-Write. Science, 353(6295):126-127 (2016).

Bruni et al. Islet cell transplantation for the treatment of type 1 diabetes: recent advances and future challenges. Diabetes Metabolic Syndrome and Obesity Targets Ther. 7:211-223, doi:10.2147/DMSO. S50789 (2014).

Caplan, Finding a solution to the organ shortage. Can Med Assoc J. 188(16):1182-1183, doi:10.1503/cmaj.151260 (2016).

Chronic Kidney Disease in the United States, 2021. Centers for Disease Control and Prevention Retrieved Jan. 28, 2026 from URL: https://www.cdc.gov/kidneydisease/publications-resources/ckd-national-facts.html. Published Mar. 4, 2021.

Cooper et al. A brief history of clinical xenotransplantation. International Journal of Surgery 23(Pt B):205-210, doi:10.1016/j.ijsu.2015.06.060 (2015).

Denner et al., Infection Barriers to Successful Xenotransplantation Focusing on Porcine Endogenous Retroviruses. Clin. Microbiol. Rev. 25(2):318-343, doi:10.1128/CMR.05011-11 (2012).

Friedrich et al., Management of End Stage Heart Failure. Heart. 93(5):626-631, doi:10.1136/hrt.2006.098814 (2007).

Gamble et al. The journey of islet cell transplantation and future development. Islets. 10(2):80-94. doi:10.1080/19382014.2018.1428511 (2018).

Griesemer, A et al. Xenotransplantation: Immunological hurdles and progress toward tolerance. Immunol. Rev. 258(1):241-258, doi:10.1111/imr.12152 (2014).

Heart Failure: Diagnosis and Treatment. Mayo Clinic Jan. 21, 2025. Retrieved Jan. 28, 2026 from URL: https://www.mayoclinic.org/diseases-conditions/heart-failure/diagnosis-treatment/drc-20373148.

Heart Failure: Symptoms and Causes. Mayo Clinic Jan. 21, 2025. Retrieved on Jan. 28, 2026 from URL: https://www.mayoclinic.org/diseases-conditions/heart-failure/symptoms-causes/syc-20373142.

Katella, 8 Things to Know About Heart Transplants. Yale Medicine Oct. 6, 2020. Retrieved Jan. 28, 2026 from URL: https://www.yalemedicine.org/news/8-things-to-know-about-heart-transplants.

Kidney Disease Statistics for the United States Fast Facts on Kidney Disease. NIDDK. Last Reviewed Sep. 2024. Retrieved Jan. 28, 2026 from URL: https://www.niddk.nih.gov/health-information/health-statistics/kidney-disease.

Liver Transplant. Mayo Clinic Jan. 23, 2026; Retrieved Jan. 28, 2026 from URL: https://www.mayoclinic.org/tests-procedures/liver-transplant/about/pac-20384842, 23 pages.

Lu T et al. Xenotransplantation: Current Status in Preclinical Research. Frontiers Immunol. 10. doi:10.3389/fimmu.2019.03060 (2019).

Mathur et al., Variation in access to the liver transplant waiting list in the United States. Transplantation, 98(1):94-99. doi:10.1097/01.tp.0000443223.89831.85 (2014).

Meier et al. Xenotransplantation: back to the future? Transplant Int. 31(5):465-477, doi:10.1111/tri.13104 (2017).

Methods for the National Diabetes Statistics Report. Centers for Disease Control and Prevention, May 15, 2024. Retrieved Jan. 26, 2026 from URL: website. https://www.cdc.gov/diabetes/data/statistics-report/index.html.

Organ Donation Statistics. Health Resources & Services Administration. Retrieved Jan. 28, 2026 from URL: https://www.organdonor.gov/statistics-stories/statistics.html.

Organ Procurement & Transplantation Network (OPTN). Health Resources & Services Administration. Retrieved Jan. 28, 2026 from URL: https://optn.transplant.hrsa.gov/data/view-data-reports/national-data/.

Ostrov et al., Design, synthesis, and testing toward a 57-codon genome. Science, 353(6301): 819-822 (2016).

Schuurman, H. J. Regulatory aspects of clinical xenotransplantation. International Journal of Surgery 23:312-321, doi:10.1016/j.ijsu.2015.09.051 (2015).

Srinivasan et al. Islet cell transplantation. Postgrad Med J. 83(978):224-229, doi:10.1136/pgmj.2006.053447 (2007).

Statistics About Diabetes. American Diabetes Association, Updated Nov. 2, 2023. Retrieved Jan. 28, 2026 from URL: https://www.diabetes.org/resources/statistics/statistics-about-diabetes, 5 pages.

The Liver Transplant Process. National Institute of Diabetes and Digestive and Kidney Diseases, Last Reviewed Mar. 2017. Retrieved Jan. 28, 2026 from URL: https://www.niddk.nih.gov/health-information/liver-disease/liver-transplant/preparing-transplant#waitingList, 5 pages.

Thomas et al., Chronic kidney disease and its complications. Prim Care Clin Office Pract. 35(2):329-344, doi:10.1016/j.pop.2008.01.008 (2008).

(56)          References Cited

OTHER PUBLICATIONS

Wang et al. Efficient, footprint-free human iPSC genome editing by consolidation of Cas9/CRISPR and piggyBac technologies. Nat. protoc. 12(1):88-103 (2017). Published online Dec. 8, 2016. doi: 10.1038/nprot.2016.152.

Yang et al., Engineering and Optimising Deaminase Fusions for Genome Editing. Nature Communications 7:13330, doi: 10.1038/ncomms13330 (2016).

Adams, Andrew B. et al. Enhancing kidney transplantation and the role of xenografts: report of a scientific workshop sponsored by the National Kidney Foundation. American Journal of Kidney Diseases 84(1):94-101 (2024).

Adams, Andrew. et al. American Society of Transplant Surgeons—American Society of Transplantation report of FDA meeting on regulatory expectations for xenotransplantation products. American Journal of Transplantation 23(9):1290-1299 (2023).

Akopian, Aram. et al. Chimeric Recombinases with Designed DNA sequence Recognition. Proceedings of the National Academy of Sciences of the United States of America 100(15):8688-8691 (2003).

Albertini, Aurelie A. V. et al. Crystal structure of the rabies virus nucleoprotein-RNA complex. Science 313(5785):360-363 (2006).

Bedell, et al. In vivo genome editing using a high-efficiency TALEN. Nature. 491.7422 (2012): 114-118.

Beerli, Roger. et al. Toward Controlling Gene Expression at Will: Specific Regulation of the Erbb-2/her-2 Promoter by Using Polydactyl Zinc Finger Proteins Constructed From Modular Building Blocks. Proceedings of the National Academy of Sciences 95(25):14628-14633 (1998).

Beumer, et al. Efficient gene targeting in *Drosophila* by direct embryo injection with zinc-finger nucleases. Proc Natl Acad Sci USA. Dec. 16, 2008. 105(50):19821-19826. doi: 10.1073/pnas.0810475105. Epub Dec. 8, 2008.

Bibikova et al., Enhancing gene targeting with designed zinc finger nucleases. Science 300:764 (2003).

Bizzarri, Ranieri. et al. Fluorescence recovery after photobleaching reveals the biochemistry of nucleocytoplasmic exchange. Analytical and Bioanalytical Chemistry 403(8):2339-2351 (2012).

Blancafort, Pilar. et al. Designing transcription factor architectures for drug discovery. Molecular Pharmacology 66(6):1361-1371 (2004).

Boch, Jens. et al. Breaking the Code of DNA Binding Specificity of TAL-Type III Effectors. Science 326(5959):1509-1512 (2009).

Boden, Daniel. et al. Efficient gene transfer of HIV-1-specific short hairpin RNA into human lymphocytic cells using recombinant adeno-associated virus vectors. Molecular Therapy 9(3):396-402 (2004).

Bolotin, Alexander. et al. Clustered regularly interspaced short palindrome repeats (CRISPRs) have spacers of extrachromosomal origin. Microbiology 151(8):2551-2561 (2005).

Brown Jr, Robert S. et al. Artificial liver support systems in acute liver failure and acute-on-chronic liver failure: systematic review and meta-analysis. Critical Care Explorations 7(1):e1199, 1-12 (2025).

Brummelkamp, et al. A system for stable expression of short interfering RNAs in mammalian cells. Science. Apr. 19, 2002;296(5567):550-3. Epub Mar. 21, 2002.

Bultmann, Sebastian. et al. Targeted transcriptional activation of silent oct4 pluripotency gene by combining designer TALEs and inhibition of epigenetic modifiers. Nucleic Acids Research 40(12):5368-5377 (2012).

Carlson, Daniel F. et al. Efficient TALEN-Mediated Gene Knockout in Livestock: Supporting Information. Proceedings of the National Academy of Sciences of the United States of America 109(43):17382-17387 (2012).

Carroll, Dana. Genome engineering with zinc-finger nucleases. Genetics 188(4):773-782 (2011).

Chang, Chieh. et al. Microtubule-based localization of a synaptic calcium-signaling complex is required for left-right neuronal asymmetry in C. elegans. Development 138(16):3509-3518 (2011).

Chang, Nannan. et al. Supplementary material: Genome Editing with RNA-guided Cas9 Nuclease in Zebrafish Embryos. Cell Research 23(4):465-472 (2013).

Cho et al., Heritable gene knockout in Caenorhabditis elegans by direct injection of Cas9-sgRNA ribonucleoproteins. Genetics. Nov. 2013;195(3):1177-80. doi: 10.1534/genetics.113.155853. Epub Aug. 26, 2013.

Cho, Seung, et al., Analysis of off-target effects of CRISPR/Cas-derived RNA-guided endonucleases and nickases. Genome Research 24(1):132-41 (2014).

Chylinski, K. and Jinek, M. A programmable dual RNA-guided DNA endonuclease in a Type II CRISPR system. 2012 Presentation, 32 pages (2012).

Chylinski, Krzysztof. et al. The tracrRNA and Cas9 families of type II CRISPR-Cas immunity systems. RNA Biology 10(5):726-737 (2013).

Cleveland, John D. et al. Gene-edited pig cardiac xenotransplantation as a bridge to allotransplantation in infants: progress in a pig-to-baboon model. American Journal of Transplantation (2025).

Close, Dan. et al. The evolution of the bacterial luciferase gene cassette (lux) as a real-time bioreporter. Sensors 12(1):732-752 (2012).

Costantini, Danny L. et al. $^{111}$In-labeled trastuzumab (Herceptin) modified with nuclear localization sequences (NLS): an Auger electron-emitting radiotherapeutic agent for HER2/neu-amplified breast cancer. Journal of Nuclear Medicine 48(8):1357-1368 (2007).

Cristea et al. In vivo cleavage of transgene donors promotes nuclease-mediated targeted integration. Biotechnol Bioeng 110(3):871-880 (2013).

Cui, Xiaoxia. et al. Targeted Integration in Rat and Mouse Embryos With Zinc-finger Nucleases. Nature Biotechnology 29(1):64-67 (2011). Published Online Dec. 12, 2010.

Dingwall et al. The nucleoplasmin nuclear location sequence is larger and more complex than that of SV-40 large T antigen. J Cell Biol. Sep. 1, 1988; 107(3): 841-849. doi: 10.1083/jcb.107.3.841.

Eghbalsaied, Shahin. et al. CRISPR/Cas9-mediated base editors and their prospects for mitochondrial genome engineering. Gene Therapy 31(5):209-223 (2024).

Erickson. Size and shape of protein molecules at the nanometer level determined by sedimentation, gel filtration, and electron microscopy. Biological Procedures Online 11(1): 32 (2009).

Fernández, Juan Pablo et al. Comparison between electroporation at different voltage levels and microinjection to generate porcine embryos with multiple Xenoantigen knock-outs. International Journal of Molecular Sciences 25(22):11894, 1-16 (2024).

Firl, Daniel J. et al. Clinical and molecular correlation defines activity of physiological pathways in life-sustaining kidney xenotransplantation. Nature Communications 14(1):3022, 1-15 (2023).

Fishman, Jay A. et al. Infectious disease surveillance and management in clinical xenotransplantation: Experience with the first human porcine kidney transplant. American Journal of Transplantation 25(11):2451-2457 (2025).

Foecking, M K. et al. Powerful and versatile enhancer-promoter unit for mammalian expression vectors. Gene 45(1):101-105 (1986).

Freitas, Natália, and Celso Cunha. Mechanisms and Signals for the Nuclear Import of Proteins. Current Genomics 10(8):550-557 (2009).

Furutama, Daisuke et al. Expression of the IP3R1 promoter-driven nls-lacZ transgene in Purkinje cell parasagittal arrays of developing mouse cerebellum. Journal of Neuroscience Research 88(13):2810-2825 (2010).

Geißler, et al. Transcriptional activators of human genes with programmable DNA-specificity. PLoS One. 2011;6(5):e19509. doi: 10.1371/journal.pone.0019509. Epub May 19, 2011.

Geurts, Aron M. et al. Knockout Rats via Embryo Microinjection of Zinc-finger Nucleases. Science 325(5939):433 (2009).

Goldfarb, David S. et al. Importin alpha: a multipurpose nuclear-transport receptor. Trends in Cell Biology 14(9):505-514 (2004).

Gordley, Russell M. et al. Synthesis of Programmable Integrases. Proceedings of the National Academy of Sciences of the United States of America 106:5053-5058 (2009).

(56)             References Cited

OTHER PUBLICATIONS

Groenendaal, Huybert. et al. Expert opinion on the identification, risk assessment, and mitigation of microorganisms and parasites relevant to xenotransplantation products from pigs. Xenotransplantation 30(5):e12815, 1-17 (2023).

Gunawardane, Lalith S. et al. A slicer-mediated mechanism for repeat-associated siRNA 5' end formation in *Drosophila*. Science 315(5818):1587-1590 (2007).

Hockemeyer, Dirk. et al. Genetic Engineering of Human Pluripotent Cells Using TALE Nucleases. Nature Biotechnology 29(8):731-734 (2011).

Hodel, Alec E. et al. Nuclear localization signal receptor affinity correlates with in vivo localization in Saccharomyces cerevisiae. Journal of Biological Chemistry 281(33):23545-23556 (2006).

Horvath et al. Diversity, Activity, and Evolution of CRISPR Loci in *Streptococcus thermophilus*. J Bacterial 190(4):1401-1412 (2008).

Izmiryan et al. Efficient gene targeting mediated by a lentiviral vector-associated meganuclease. Nucleic Acids Res. Sep. 2011 ;39(17):7610-19.

Jensen, Nanna M. et al. An update on targeted gene repair in mammalian cells: methods and mechanisms. Journal of Biomedical Science 18(1):10 (2011).

Karran, Peter. DNA double strand break repair in mammalian cells. Current Opinion in Genetics & Development 10(2):144-150 (2000).

Kato, Yoshio. et al. Relationships between the activities in vitro and in vivo of various kinds of ribozyme and their intracellular localization in mammalian cells. Journal of Biological Chemistry 276(18):15378-15385 (2001).

Kawai, Tatsuo. et al. Xenotransplantation of a porcine kidney for end-stage kidney disease. N Engl J Med 392(19):1933-1940 (2025).

Kim, Daniel H. and John J. Rossi. RNAi mechanisms and applications. BioTechniques 44(5):613-616 (2008).

Kim, Hye Joo. et al. Targeted Genome Editing in Human Cells with Zinc Finger Nucleases Constructed via Modular Assembly. Genome Research 19(7):1279-1288 (2009).

Kim, Yang-Gyun. et al. Hybrid Restriction Enzymes: Zinc Finger Fusions to Fok I Cleavage Domain. Proceedings of the National Academy of Sciences of the United States of America 93(3):1156-1160 (1996).

Laumonier, Thomas. et al. Lentivirus mediated HO-1 gene transfer enhances myogenic precursor cell survival after autologous transplantation in pig. Molecular Therapy 16(2):404-410 (2008). Published online Nov. 20, 2007.

Lee, Jeong-Soo. et al. RNA-guided genome editing in *Drosophila* with the purified Cas9 protein. G3: Genes, Genomes, Genetics 4(7):1291-1295 (2014).

Liang et al., Homology-directed repair is a major double-strand break repair pathway in mammalian cells. Proc. Natl. Acad. Sci. 95:5172-5177 (1998).

Lieber, Andre. et al. High level gene expression in mammalian cells by a nuclear T7-phage RNA polymerase. Nucleic Acids Research 17(21):8485-8493 (1989).

Lieber, M. R. The mechanism of double-strand DNA break repair by the nonhomologous DNA end-joining pathway. Annual review of biochemistry 79, 181-211 (2010).

Lintner, Nathanael G. et al. Structural and functional characterization of an archaeal clustered regularly interspaced short palindromic repeat (CRISPR)-associated complex for antiviral defense (CASCADE). Journal of Biological Chemistry 286(24):21643-21656 (2011).

Lombardo, Angelo. et al. Gene editing in human stem cells using zinc finger nucleases and integrase-defective lentiviral vector delivery. Nature biotechnology 25(11):1298-1306 (2007).

Lombardo, Angelo. et al. Supplementary material: Gene editing in human stem cells using zinc finger nucleases and integrase-defective lentiviral vector delivery. Nature biotechnology 25(11):1298-1306 (2007).

Ma, David. et al. Kidney transplantation from triple-knockout pigs expressing multiple human proteins in cynomolgus macaques. American Journal of Transplantation 22(1):46-57 (2022).

Mali, Prashant. et al. CAS9 transcriptional activators for target specificity screening and paired nickases for cooperative genome engineering. Nature Biotechnology 31(9):833-838 (2013).

Manook, Miriam. et al. Prolonged xenokidney graft survival in sensitized NHP recipients by expression of multiple human transgenes in a triple knockout pig. Science Translational Medicine 16(751):eadk6152, 1-29 (2024).

Maresca et al. Obligate ligation-gated recombination (ObLiGaRe): custom-designed nuclease-mediated targeted integration through nonhomologous end joining. Genome Res 23:539-546 (2013).

McConnell, Brice V. et al. Nuclear and cytoplasmic LIMK1 enhances human breast cancer progression. Molecular Cancer 10(1):75, 1-13 (2011).

Medina, Maira Fe C., and Sadhna Joshi. RNA-polymerase III-driven expression cassettes in human gene therapy. Current Opinion in Molecular Therapeutics 1(5):580-594 (1999).

Mercer et al., Chimeric TALE recombinases with programmable DNA sequence specificity. Nucleic Acids Res. Nov. 2012;40(21):11163-72. doi: 10.1093/nar/gks875. Epub Sep. 26, 2012.

Miller, Daniel G. et al. Human gene targeting by adeno-associated virus vectors is enhanced by DNA double-strand breaks. Molecular and Cellular Biology 23(10):3550-3557 (2003).

Miyagishi, M., and Kazunari Taira. U6 promoter-driven siRNA with four uridine 3' overhangs efficiently suppress targeted gene expression in mammalian cells. Nature Biotechnology 19:497-500 (2002).

Miyawaki, Atsushi. et al. Fluorescent indicators for Ca2+ based on green fluorescent proteins and calmodulin. Nature 388(6645):882-887 (1997).

Møller, Henrik Devitt. et al. CRISPR-C: circularization of genes and chromosome by CRISPR in human cells. Nucleic Acids Research 46(22):e131, 1-13 (2018).

Moehle et al., Targeted gene addition into a specified location in the human genome using designed zinc finger nucleases. PNAS 104:3055-3060 (2007).

Mojica et al. Intervening sequences of regularly spaced prokaryotic repeats derive from foreign genetic elements. J Mol Evol 60(2):174-182 (2005).

Mojica, Francisco J. M., and Lluis, Montoliu. On the origin of CRISPR-Cas technology: from prokaryotes to mammals. Trends in Microbiology 24(10):811-820 (2016).

Moscou, Matthew J. et al. A simple cipher governs DNA recognition by TAL effectors. Science 326(5959):1501 (2009).

Mussolino, C., and Cathomen T. Tale nucleases: tailored genome engineering made easy. Current Opinion in Biotechnology 23(5):644-650 (2012). (Abstract only).

Mussolino et al., TALE nucleases: tailored genome engineering made easy. Curr Opin Biotechnol. Oct. 2012;23(5):644-50. doi: 10.1016/j.copbio.2012.01.013. Epub Feb. 17, 2012.

Nomura, Wataru. et al. In vivo site-specific DNA methylation with a designed sequence-enabled DNA methylase. Journal of the American Chemical Society 129(28):8676-8677 (2007).

Nozawa, Takashi. et al. CRISPR inhibition of prophage acquisition in *Streptococcus pyogenes*. PLoS One 6(5):e19543, 1-10 (2011).

Odorico, Jon. et al. Report of the key opinion leaders meeting on stem cell-derived beta cells. Transplantation 102(8):1223-1229 (2018).

O'Gorman, Stephen. et al. Recombinase-mediated gene activation and site-specific integration in mammalian cells. Science 251(4999):1351-1355 (1991).

O'Hare, K. et al. Transformation of Mouse Fibroblasts to Methotrexate Resistance by a Recombinant Plasmid Expressing a Prokaryotic Dihydrofolate Reductase. PNAS USA 78(3):1527-1531 (1981).

Orlando et al. Zinc-finger nuclease-driven targeted integration into mammalian genomes using donors with limited chromosomal homology. Nuc Acids Res 38(15):e152.

Pante, Nelly, and Michael Kann. Nuclear pore complex is able to transport macromolecules with diameters of ~39 nm. Molecular Biology of the Cell 13(2):425-434 (2002).

Papworth, Monika. et al. Inhibition of herpes simplex virus 1 gene expression by designer zinc-finger transcription factors. Proceedings of the National Academy of Sciences 100(4):1621-1626 (2003).

Patterson, Stacey S. et al. Codon optimization of bacterial luciferase (lux) for expression in mammalian cells. Journal of Industrial Microbiology and Biotechnology 32(3):115-123 (2005).

(56) References Cited

OTHER PUBLICATIONS

Paul, Cynthia P. et al. Localized expression of small RNA inhibitors in human cells. Molecular Therapy 7(2):237-247 (2003).

Perez, Elena. et al. Establishment of HIV-1 Resistance In CD4+ T Cells by Genome Editing using Zinc-Finger Nucleases. Nature Biotechnology 26(7):808-816 (2008).

Petitpas, Kaitlyn et al. Genetic modifications designed for xenotransplantation attenuate sialoadhesin-dependent binding of human erythrocytes to porcine macrophages. Xenotransplantation 29(6):e12780, 1-9 (2022).

Policastro, Robert A. and Gabriel E. Zentner. Global approaches for profiling transcription initiation. Cell Reports Methods 1(5):100081, 1-14 (2021).

Puchta, Holger. The repair of double-strand breaks in plants: mechanisms and consequences for genome evolution. Journal of Experimental Botany 56(409):1-14 (2005).

Qi, Lei. S et al. Repurposing CRISPR as an RNA-guided Platform for Sequence-specific Control of Gene Expression. Cell 152(5):1173-1183 (2013).

Ran, F. Ann. et al. Double Nicking by RNA-guided CRISPR Cas9 for Enhanced Genome Editing Specificity. Cell 154(6):1380-1389 (2013).

Remy, Severine. et al. Zinc-finger nucleases: a powerful tool for genetic engineering of animals. Transgenic Research 19(3):363-371 (2010). Published online Sep. 26, 2009.

Rivenbark, Ashley G. et al. Epigenetic reprogramming of cancer cells via targeted DNA methylation. Epigenetics 7(4):350-360 (2012).

Roberts, Bruce L. et al. The effect of protein context on nuclear location signal function. Cell 50(3):465-475 (1987).

Rouet et al., Introduction of Double-Strand Breaks Into the Genome of Mouse Cells by Expression of a Rare-Cutting Endonuclease. Molecular and Cellular Biology, 14.12 (Dec. 1994): 8096-8106.

Rudin, et al. Efficient repair of HO-induced chromosomal breaks in Saccharomyces cerevisiae by recombination between flanking homologous sequences. Molecular and Cellular Biology 8(9):3918-3928 (1988).

Salomon, Siegfried, and Holger Puchta. Capture of genomic and T-DNA sequences during double-strand break repair in somatic plant cells. EMBO Journal 17(20):6086-6095 (1998).

Sapranauskas, Rimantas et al. The *Streptococcus thermophilus* CRISPR/Cas System provides Immunity in *Escherichia coli.* Nucleic Acids Research 39(21):9275-9282 (2011).

Sato, Keisuke. et al. Generation of adeno-associated virus vector enabling functional expression of oxytocin receptor and fluorescence marker genes using the human elF4G internal ribosome entry site element. Bioscience, Biotechnology, and Biochemistry 73(9):2145-2148 (2009).

Schramm, Laura, and Nouria Hernandez. Recruitment of RNA polymerase III to its target promoters. Genes & Development 16(20):2593-2620 (2002).

Shah, Shiraz Ali. et al. Distribution of CRISPR spacer matches in viruses and plasmids of crenarchaeal acidothermophiles and implications for their inhibitory mechanism. Microbiology 37(Pt 1):23-28 (2009).

Shaked, Abraham. et al. Extracorporeal liver cross-circulation using transgenic xenogeneic pig livers with brain-dead human decedents. Nature Medicine :1-11 (2026).

Shaked, Abraham. et al. Genetically modified porcine liver xenograft survival in a human decedent model. American Journal of Transplantation 25(11):2479-2481 (2025).

Shen, Bin. et al. Generation of gene-modified mice via Cas9/RNA-mediated gene targeting. Cell Research 23(5):720-723 (2013).

Snowden, Andrew W. et al. Gene-specific targeting of H3K9 methylation is sufficient for initiating repression in vivo. Current Biology 12(24):2159-2166 (2002).

Sorek, Rotem et al. CRISPR—a widespread system that provides acquired resistance against phages in bacteria and archaea. Nature Reviews Microbiology 6(3):181-186 (2008).

Souilhol, Celine. et al. Nas transgenic mouse line allows visualization of Notch pathway activity in vivo. Genesis 44(6):277-286 (2006).

Sung, Young Hoon. et al. Highly efficient gene knockout in mice and zebrafish with RNA-guided endonucleases. Genome Research 24(1):125-131 (2014). Published online Nov. 19, 2013.

Tan, Siyuan et al. Zinc-finger protein-targeted gene regulation: genomewide single-gene specificity. Proceedings of the National Academy of Sciences 100(21):11997-12002 (2003).

Tan, Wenjie et al. Human immunodeficiency virus type 1 incorporated with fusion proteins consisting of integrase and the designed polydactyl zinc finger protein E2C can bias integration of viral DNA into a predetermined chromosomal region in human cells. Journal of Virology 80(4):1939-1948 (2006).

Tesson, Laurent. et al. Knockout Rats Generated by Embryo Microinjection of TALENs. Nature Biotechnology 29(8):695-696 (2011).

Thomas, Kirk R. et al. High frequency targeting of genes to specific sites in the mammalian genome. Cell 44(3):419-428 (1986).

Upadhyay, Santosh Kumar. et al. RNA-guided genome editing for target gene mutations in wheat. G3: Genes, Genomes, Genetics 3(12):2233-2238 (2013).

Villion, Manuela, and Sylvain Moineau. The double-edged sword of CRISPR-Cas systems. Cell Research 23(1):15-17 (2013). Published online Sep. 4, 2012.

Wang et al., One-Step Generation of Mice Carrying Mutations in Multiple Genes by CRISPR/Cas-Mediated Genome Engineering. Cell 153: 910-918 (2013).

Waterhouse, Peter M., and Christopher A. Helliwell. Exploring plant genomes by RNA-induced gene silencing. Nature Reviews Genetics 4(1):29-38 (2003).

Wente, Susan R. et al. The nuclear pore complex and nuclear transport. Cold Spring Harbor Perspectives in Biology 2(10):a000562, 1-19 (2010).

Yarris, Lynn. Programmable DNA scissors found for bacterial immune system. News Center :1- 4 (2012).

Al-Attar et al., Clustered Regularly Interspaced Short Palindromic Repeats (CRISPRs ): The Hallmark of an Ingenious Antiviral Defense Mechanism in Prokaryotes, Bio Chem. (2011) vol. 392, Issue 4, pp. 277-289.

Alberts et al., Molecular Biology of the Cell, Fifth Ed., 699-707 (2008).

Baker, M., "Gene editing at CRISPR speed," Nature Biotechnology, 2014, vol. 32(4), pp. 309-312.

Barrangou, R. (2012). RNA-mediated programmable DNA cleavage. Nature biotechnology, 30(9), 836-838. doi:10.1038/nbt.2357.

Bassett, A.R. and Liu, J.-L., "CRISPR!Cas9 and Genome Editing in *Drosophila,*" Journal of Genetics and Genomics, 2014, vol. 41, pp. 7-19 (including supplementary materials).

Bobis-Wozowicz, Anna Osiak et al., "Targeted genome editing in pluripotent stem cells using zinc-finger nucleases", Methods, 2011, vol. 53, pp. 339-346.

Borner et al., Human Gene Therapy, vol. 25, No. 11, pp. A24, Abstract No. OR001 (2014).

Brouns, SJ Molecular biology. A Swiss army knife of immunity. Science 337(6069)808-9 (Aug. 17, 2012).

Brunet et al. Chromosomal translocations induced at specified locii in human stem cells. PNAS 106(26):10620-10625 (2009).

Campeau, E. et al. "A versatile viral system for expression and depletion of proteins in mammalian cells." PLoS One 4, e6529 (2009).

Carlson et al., Targeting DNA with Fingers and TALENs. Molecular Therapy-Nucleic Acid, 1(2012): 1-4.

Carney, J. et al., "Induction of DNA Double-Strand Breaks by Electrocorporation of Restriction Enzymes into Mammalian Cells." Methods in Mol. Bioi., vol. 113, pp. 465-471 (1999).

Carroll, "A CRISPR Approach to Gene Targeting" 20(9) Molecular Therapy 1658-1660 (Sep. 2012).

Carroll, D. et al., "Design, construction and in vitro testing of zinc finger nucleases." Nature Protocols, vol. 1(3), pp. 1329-1341 (2006).

Carroll, "Progress and prospects: Zinc-finger nucleases as gene therapy agents," Gene Therapy 15: 1463-1468 (2008).

(56) References Cited

OTHER PUBLICATIONS

Cermak et al., Efficient design and assembly of custom TALEN and other TAL effector-based constructs for DNA targeting. Nucleic Acids Research 39(12):e82 (2011).

Chang et al. Genome editing with RNA-guided Cas9 nuclease in zebrafish embryos. Cell Res 23:465-472 (2013).

Chapdelaine, P. et al., "Meganucleases can restore the reading frame of a mutated dystrophin." Gene Therapy, vol. 17, pp. 846-858 (2010).

Chen, C. et al., "Transfection and expression of plasmid DNA in plant cells by an arginine-rich intracellular delivery peptide without protoplast preparation," FEBS Letters, vol. 581, pp. 1891-1897 (2007).

Cho, Seung Woo, et al., Targeted Genome Engineering In Human Cells With The Cas9 RNA-guided Endonuclease. Nature Biotechnology 31(3):230-232 (2013).

Christian et al., "Targeting DNA Double-Strand Breaks with TAL Effector Nucleases," Genetics 186: 157-161 (2010).

Cong et al. Comprehensive interrogation of natural TALE DNA-binding modules and transcriptional repressor domains. Nat Commun. Jul. 24, 2012;3:968. doi: 10.1038/ncomms1962.

Cong et al.: Multiplex Genome Engineering Using CRISPR/Cas Systems. Science 339(6121):819-823 (2013).

Cooper, David, et al., Justification of Specific Genetic Modifications in Pigs for Clinical Organ Xenotransplantation. Xenotransplantation. 26:1-12 (2019).

Cooper et al., The Role of Genetically Engineered Pigs in Xenotransplantation Research. Journal of Pathology 238: 288-299 (2016).

Deltcheva, E. et al., "CRISPR RNA maturation by trans-encoded small RNA and host factor RNase III," Nature, vol. 471(7340), pp. 602-607 (doi:10.1038/nature09886), plus Supplementary Material (2011).

Dominguez et al., Beyond editing: repurposing CRISPR-Cas9 for precision genome regulation and interrogation. Nat Rev Mol Cell Biol 17: 5-15 (2015).

Dunn et al., "Genetic Modification of Porcine Endogenous Retrovirus (PERV) Sequences in Cultured Pig Cells as a Model for Decreasing Infectious Risk in Xenotransplantation," FASEB Journal, vol. 29, No. 1_Supplement, Abstract No. LB761. (2015).

EP21738016.1 Partial Supplementary European Search Report dated Feb. 6, 2024.

EP23197923.8 Extended European Search Report dated Dec. 15, 2023.

Fieck, A. et al., "Modifications of the *E. coli* Lac repressor for expression in eukaryotic cells: effects of nuclear signal sequences on protein activity and nuclear accumulation." Nucleic Acids Res., vol. 20{7}, pp. 1785-1791 {1992}.

Fischer-Fantuzzi, L. et al., "Cell-Dependent Efficiency of Reiterated Nuclear Signals in a Mutant Simian Virus 40 Oncoprotein Targeted to the Nucleus," Molecular and Cellular Biology, vol. 8(12), pp. 5495-5503 (1988).

Fisicaro et al., Versatile Co-expression of Graft-Protective Proteins Using 2A-Linked Cassettes. Xenotransplantation 18: 121-130 (2011).

Fujii, Wataru, et al. Efficient generation of large-scale genome-modified mice using gRNA and CAS9 endonuclease. Nucleic acids research. vol. 41, Issue No. 20 (2013): e187.

Gaj et al., Targeted gene knockout by direct delivery of zinc-finger nuclease proteins. Nat Methods, 1;9(8):805-7 (2012).

Gantz, J. et al. "Targeted Genomic Integration of a Selectable Floxed Dual Fluorescence Reporter in Human Embryonic Stem Cells." PLOS One, vol. 7(10):e46971 (2012).

Gao, Z. et al., "Delineation of the Exact Transcription Termination Signal for Type 3 Polymerase III," Molecular Therapy—Nucleic Acids, vol. 10, pp. 36-44, plus Supplementary Material (2018).

Gasiunas et al., Cas9-crRNA ribonucleoprotein complex mediates specific DNA cleavage for adaptive immunity in bacteria. Proc Natl Acad Sci U S A. Sep. 25, 2012; 109(39): E2579-E2586.

"Gene Transfer and Expression in Mammalian Cells," Elsevier Science B.V., Table 1 (2003).

Gilbert et al., CRISPR-Mediated modular RNA-guided regulation of transcription in Eukaryotes. Cell 154(2): 442-451 (2013).

Good et al. "Expression of small, therapeutic RNAs in human cell nuclei" Gene Therapy (1997) 4, pp. 45-54.

Gopalan, V. et al., "RNase P: Variations and Uses*." The Journal of Biological Chemistry, vol. 277(9), pp. 6759-6762 (2002).

Gratz, S. et al., "Genome engineering of Drosophila with the CRISPR RNA-guided Cas9 nuclease," Genetics, vol. 194, pp. 1029-1035, plus Supplementary Material (2013).

Groth, et al. "A phage integrase directs efficient site-specific integration in human cells", PNAS, 2000, vol. 97, No. 11, paQes 5995-6000.

Gustafsson, C. et al., "Codon bias and heterologous protein expression." Trends Biotech., vol. 22(7), pp. 346-353 (2004).

Hale et al., Essential Features and Rational Design of CRISPR RNAs That Function With the Cas RAMP Module Complex to Cleave RNAs, Molecular Cell, (2012) vol. 45, Issue 3, 292-302.

Handel et al.: Versatile and Efficient Genome Editing in Human Cells by Combining Zinc-finger Nucleases With Adeno-associated Viral Vectors. Human Gene Therapy 23(3):321-329 (2012).

Haralambieva, Iana et al., Genome-wide Associations of Cd46 and IFI44L Genetic Variants With Neutralizing Antibody Response to Measles Vaccine. Hum Genet 136:421-435(2017).

Hatoum-Aslan, et al. 'Mature clustered, regularly interspaced, short palindromic repeats RNA 5,9, 14 (crRNA) length is measured by a ruler mechanism anchored at the precursor processing site.' Proceedings of the National Academy of Sciences. vol. 108, No. 52. pp. 21218-21222. Dec. 2011. entire document.

Hockemeyer, D. et al. "Gene Targeting in Human Pluripotent Cells." Cold Spring Harbor Symposia for Quantitative Biology, vol. 75, pp. 201-209 (2010).

Hsu, Patrick, et al. DNA targeting specificity of RNA-guided Cas9 nucleases. Nat Biotechnol. Vol. 31, Issue No. 9 (2013): 827-832.

Hu, P. et al., "Comparison of Various Nuclear Localization Signal-Fused Cas9 Proteins and Cas9 mRNA for Genome Editing in Zebrafish." G3, vol. 8, pp. 823-831 (2018).

Huang et al., The Flaws and Future of Islet Volume Measurements. Cell Transplant 27: 1017-1026 (2018).

Hwang, Woong, et al. Efficient genome editing in zebrafish using a CRISPR-Cas system. Nat. Biotechnol. vol. 31, Issue No. 3 (2013): 227-229.

Jinek et al.RNA-programmed genome editing in human cells, eLife 2013;2:e00471 doi: 10.7554/eLife.00471. 14 pages. Retrieved Mar. 23, 2020 from URL: https://elifesciences.org/articles/00471 .

Jinek, Martin, et al. A programmable dual-RNA-guided DNA endonuclease in adaptive bacterial immunity. Science. Vol. 337, Issue No. 6096 (2012) :816-821.

Joung et al. TALENs: a widely applicable technology for targeted genome editing. Nat Rev Mol Cell Bio 14:49-55 (2013).

Kalderon, D. et al., "A Short Amino Acid Sequence Able to Specify Nuclear Location," Cell, vol. 39, pp. 499-509 (1984).

Kaur, Sukhbir et al., Heparan Sulfate Modification of the Transmembrane Receptor CD47 Is Necessary for Inhibition of T Cell Receptor Signaling by Thrombospondin-1. The Journal of Biological Chemistry 286(17):14991-15002(2011).

Kefeng Dou., Xenotransplantation. People's Military Medical Press 316-318 (2014).

Kim et al. Precision genome engineering with programmable DNA-nicking enzymes. Genome Res 22(7):1327-1333 (2012).

Kim, Youngjin, et al., Islet-like Organoids Derived from Human Pluripotent Stem Cells Efficiently Function in the Glucose Responsiveness in Vitro and in Vivo. Scientific Reports. 6:1-13 (2016).

Kong et al., Genetic Characteristics of Polycistronic System-mediated Randomly-inserted Multi-transgenes in Miniature Pigs and Mice. Molecular Medicine Reports 17: 37-50 (2018).

Kuspa, A. et al., "Tagging developmental genes in Dictyostelium by restriction enzyme-mediated integration of plasmid DNA." Proc. Natl. Acad. Sci. USA, vol. 89(18), pp. 8803-8807 (1992).

Kuzmine, I. et al. "Binding of the priming nucleotide in the initiation of transcription by T7 RNA polymerase." J. Biol. Chem. 278(5): 2819-2823 (2003).

(56)         References Cited

OTHER PUBLICATIONS

Lange, et al. Classical Nuclear Localization Signals: Definition, Function, and Interaction with Importin α*,s. J Biol Chem. Feb. 23, 2007; 282(8): 5101-5105.

Le Provost et al., Zinc Finger Nuclease Technology Heralds a New Era in Mammalian Transgenesis. Trends in Biotechnology, 28.3 (Mar. 2010): 134-141. Available online Dec. 16, 2009. DOI: https://doi.org/10.1016/j.tibtech.2009.11.007 .

Lee, Ciaran M., et al., "Correction of the DF508 Mutation in the Cystic Fibrosis Transmembrance Conductance Regulator Gene by Zinc-Finger Nuclease Homology-Directed Repair", BioResearch Open Access? Jun. 2012, vol. 1, pp. 99-108.

Lee et al., Targeted Chromosomal Deletions in Human Cells Using Zinc Finger Nucleases. Genome Research, 20 (Dec. 1, 2009): 81-89.

Lee, H. et al., "Targeted chromosomal duplications and inversions in the human genome using zinc finger nucleases." 3enome Res., vol. 22, pp. 539-548 {2012}.

Lewin, B. et al., Cells, p. 224 (2007).

Li et al. Modularly assembled designer TAL effector nucleases for targeted gene knockout and gene replacement in eukaryotes. Nucleic Acids Res. Aug. 2011; 39(14): 6315-6325. Published online Mar. 31, 2011. doi: 10.1093/nar/gkr188.

Li et al. TAL Nucleases (TALNs): Hybrid Proteins Composed Of TAL Effectors And FokI DNA-Cleavage Domain. Nucleic Acids Research, 39.1 (Aug. 10, 2010): 359-372.

Link, K. et al., "Engineering ligand-responsive gene-control elements: lessons learned from natural riboswitches." Gene Therapy, vol. 16{10), pp. 1189-1201 {2009}.

"Lipofectamine 2000 Transfection Reagent" (ThermoFisher Scientific website).

Liu et al., "Combinatorial RNAi Against HIV-1 Using Extended Short Hairpin RNAs," Molecular Therapy, vol. 17, No. 10, pp. 1712-1723 (2009).

Liu, P. et al., "Generation of a Triple-Gene Knockout Mammalian Cell Line Using Engineered Zinc-Finger Nucleases." Biotechnol Bioeng., vol. 106(1), pp. 97-105 (2010).

Lyssenko, N. et al., "Cognate putative nuclear localization signal effects strong nuclear localization of a GFP reported and facilitates gene expression studies in Caenhoghabditis elegans," Biotechniques, vol. 43, pp. 596-600 (2007).

Ma, S. et al., "Highly Efficient and Specific Genome Editing in Silkworm Using Costom TALENs." PLoS One, vol. 7(9), e45035 (2012).

Makarova et al. Annotation and Classification of CRISPR-Cas Systems. Method Mol Biol 1311:47-75 (2015).

Makarova et al. Evolution and classification of the CRISPR-Cas systems. Nat Rev Microbiol. 9(6):467-77 (2011).

Mali et al. Cas9 as a versatile tool for engineering biology. Nat Methods 10:957-963 (2013).

Mali et al., RNA-Guided Human Genome Engineering via Cas9. Science 339: 823-826 (2013).

Maraia, R. et al., "3' processing of eukaryotic precursor tRNAs," Wiley Interdiscip Rev RNA, vol. 2 (3), pp. 362-375 (2010).

Martin et al., Expression of pig endogenous retrovirus by primary porcine endothelial cells and infection of human cells. LANCET. 352:692-694 (1998).

Mastroianni, M. et al., "Group II Intron-Based Gene Targeting Reactions in Eukaryotes." PLoS One, vol. 3(9), e3121 (2008).

Miller et al. A TALE nuclease architecture for efficient genome editing. Nat Biotechnol. 29.2 (Feb. 2011): 143-8. doi: 10.1038/nbt.1755. Epub Dec. 22, 2010.

Morgan, W. et al., "Inducible Expression and Cytogenetic Effects of the EcoRI Restriction Endonuclease in Chinese Hamster Ovary Cells." Molecular and Cellular Biology, vol. 8(10), pp. 4204-4211 (1988).

Nishimasu et al. Crystal Structure of Cas9 in Complex with Guide RNA and Target DNA. Cell 156(5):935-949 (2014).

Niu et al., Inactivation of porcine endogenous retrovirus in pigs using CRISPR-Cas9. Science, Published Aug. 10, 2017 on Science First Release DOI: 10.1126/science.aan4187, plus Supplementary Materials, 26 pages.

Park, K M, et al., "Tissue Engineering and Regenerative Medicine 2017: A Year in Review," Tissue Engineering; Part B, vol. 24, No. 5, pp. 327-344. (2018).

PCT/US2016/055916 Third Party Observation dated Feb. 7, 2018.

Perez-Pinera, P. "Advances in Targeted Genome Editing." Current Opinion in Chemical Biology, 16 (3-4), 268-277 (2012).

PHcRed1 Vector Information Sheet, Clontech Laboratories, Inc. (2003).

Planey, S. et al., "Mechanisms of Signal Transduction: Inhibition of Glucocorticoid-induced Apoptosis in 697 Pre-B Lymphocytes by the Mineralocorticoid Receptor N-terminal Domain." J. Bioi. Chem, vol. 277{44}, pp. 42188-42196 (2002).

Porteus et al., Chimeric Nucleases and Gene Targeting GFP Gene Targeting System, Science. May 2, 2003; vol. 300 (5620):763.

Pougach et al., "CRISPR Adaptive Immunity Systems of Prokaryotes," Molecular Biology, vol. 46, No. 2, pp. 175-182 (2012).

PShooter Vector User Guide, Invitrogen (2012).

Qi, L. et al., "RNA Processing Enables Predictable Programming of Gene Expression," Nature Biotechnology, 2012, vol. 30(1 0), pp. 1002-1007 (including Supplementary Information).

Radulovich, N. et al. "Modified gateway system for double shRNA expression and Cre/lox based gene expression." BMC Biotech. 11, 1-9 (2011).

Ramirez et al. Engineered zinc finger nickases induce homology-directed repair with reduced mutagenic effects. Nucl Acids Res 40(12):5560-5568 (2012).

Ran, Ann, et al. Genome engineering using the CRISPR-Cas9 system. Nature Protocols. vol. 8, Issue No. 11 (2013): 2281-2308.

Raymond, C.S. and Soriano, P., "High-Efficiency FLP and PhiC31 Site-Specific Recombination in Mammalian Cells," PLoS One, 2007, vol. 2(1), p. e162.

Rebar, E.J. et al. "Induction of angiogenesis in a mouse model using engineered transcription factors." Nature Medicine. 8: 1427-1432 (2002).

Regalado: Who owns the biggest biotech discover of the century?. MIT Technology Review. 4 pages (2014).

Reiss et al., RecA protein stimulates homologous recombination in plants. Proceedings of the National Academy of Sciences, 93 (Apr. 1996): 3094-3098.

Rho, Mina et al. 'Diverse CRISPRs Evolving in Human Microbiomes.' PLoS Genetics. vol. 8, No. 6. 1-14 pp. 1-12. Jun. 2012. entire document.

Rhun, Anais et al., "Small RNAs in streptococci," RNA Biology, Apr. 2012, vol. 9, pp. 414-426.

Riesbeck et al., "Human Tissue Factor Pathway Inhibitor Fused to CD4 Binds both FXa and TF/FVIIa at the Cell Surface." Thromb Haemost, 1997;78:1488-1494.

Robson et al., Disordered Regulation of Coagulation and Platelet Activation in Xenotransplantation. Xenotransplantation 7: 166-176 (2000).

Sanjana, N. et al. "A Transcription Activator-Like Effector (TALE) Toolbox for Genome Engineering." Nat. Proto. vol. 7(1):171-192 (2011).

Sauer, Brian et al., Site-specific DNA recombination in mammalian cells by the Cre recombinase of bacteriophage P1, Proc. Natl. Acad. Sci. USA, vol. 85, pp. 5166-5170, Jul. 1988. Genetics.

Schiestl, R. et al., "Integration of DNA fragments by illegitimate recombination in Saccharomyces cerevisiae." Proc. Natl. Acad. Sci. USA, vol. 88(17), pp. 7585-7589 (1991).

Schultz, J. et al., "Development of a CRISPR/Cas9 system for high efficiency multiplexed gene deletion in Rhodosporidium toruloides." Biotechnology and Bioengineering, vol. 116, pp. 2103-2109 (2019).

Singer et al., "Applications of Lentiviral Vectors for shRNA Delivery and Transgenesis," Curr. Gene Ther., vol. 8(6), pp. 483-488 (2008).

Sontheimer et al., "Project 7: Establishing RNA-Directed DNA Targeting in Eukaryotic Cells; Project dates: Nov. 16, 2011 to Dec. 31, 2012" (Feb. 4, 2012).

(56)  References Cited

OTHER PUBLICATIONS

Tuschl et al., Expanding small RNA interference, Nat. Biotech. 20:446-448 (2002).

Urnov, F.D., et al., "Genome editing with engineered zinc finger nucleases" Nature Reviews Genetics, Sep. 2010, vol. 11, pp. 636-646.

U.S. Appl. No. 16/607,074 Office Action dated Apr. 4, 2022.

U.S. Appl. No. 16/607,074 Office Action dated Jan. 3, 2023.

U.S. Appl. No. 16/607,074 Notice of Allowance dated Sep. 20, 2023.

U.S. Appl. No. 16/607,074 Notice of Allowance dated Sep. 28, 2023.

U.S. Appl. No. 16/607,074 Notice of Allowance dated Jan. 18, 2024.

Wieland, M. et al., "Engineering of ribozyme-based riboswitches for mammalian cells." Methods, vol. 56., pp. 351-357 {2012}.

Wilson et al., Mammal Species of the World: a Taxonomic and Geographic Reference. Smithsonian Institution Press. 2nd Edition 75: 239-243 (1993).

Wong et al., The ABCs of Gene Cloning, Springer Science & Business Media, 93-124 (2005).

Yamamoto et al., Old World Monkeys Are Less Than Ideal Transplantation Models for Testing Pig Organs Lacking Three Carbohydrate Antigens (Triple-knockout). Scientific Reports 10: 9771 (2020).

Yang et al., Genome-wide inactivation of porcine endogenous retroviruses (PERVs), Science, 2015, vol. 350, No. 6264 pp. 1101-1104 plus Supplementary Materials, 46 pages.

Zeyland, J, et al., The Current State of Xenotransplantation. Journal of Applied Genetics 56:211-218 (2015).

Zhang et al., Efficient construction of sequence-specific TAL effectors for modulating mammalian transcription. Nature Biotechnology, 29(2):149-153; Published online Jan. 19, 2011.

Zhang et al., Programmable Sequence-Specific Transcriptional Regulation of Mammalian Genome Using Designer TAL Effectors, Nat Biotechnol. Feb. 2011; 29(2): 149-153.

* cited by examiner

Lactate Clearance during Ex-Vivo Perfusion

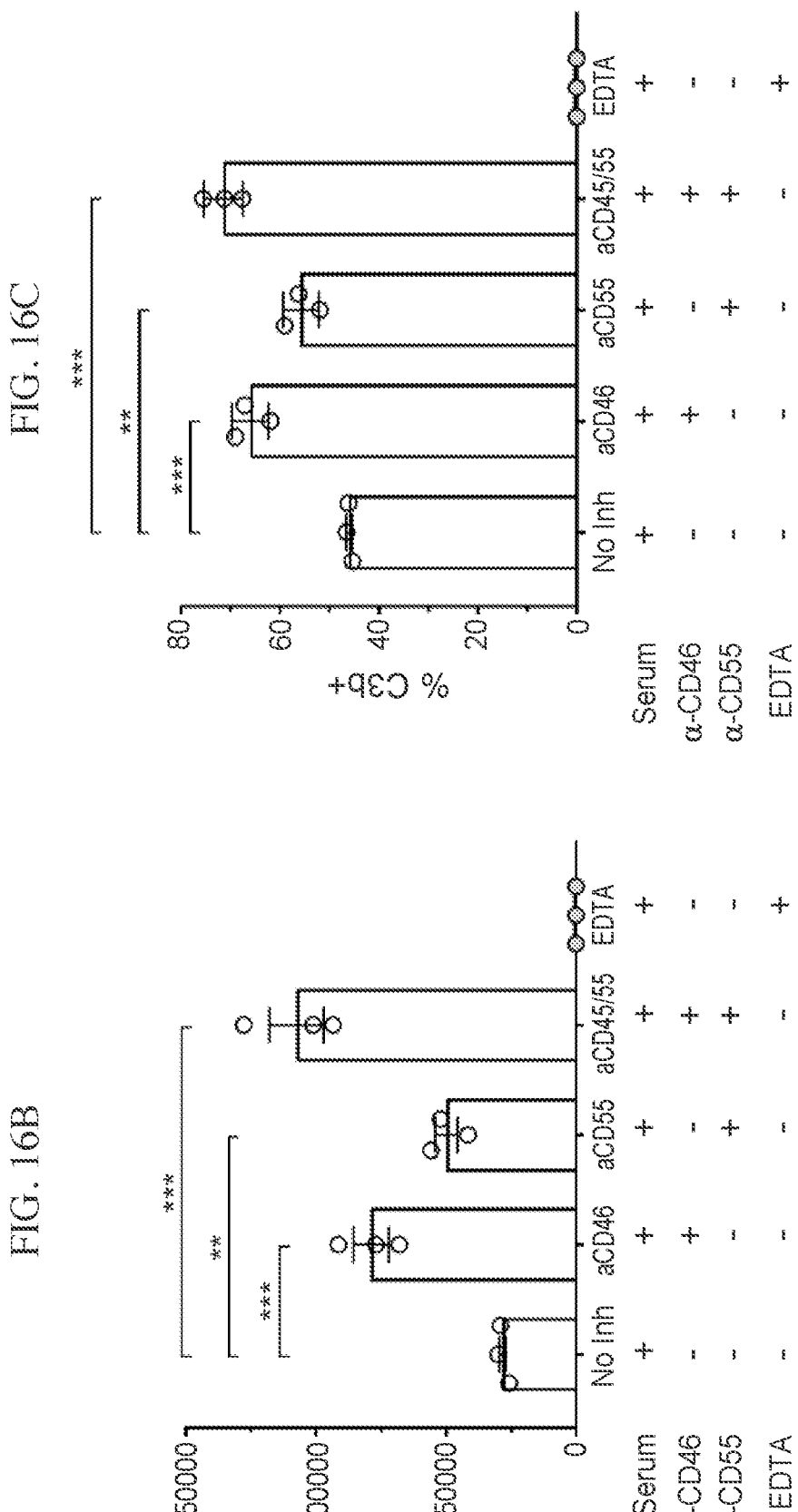

FIG. 19B
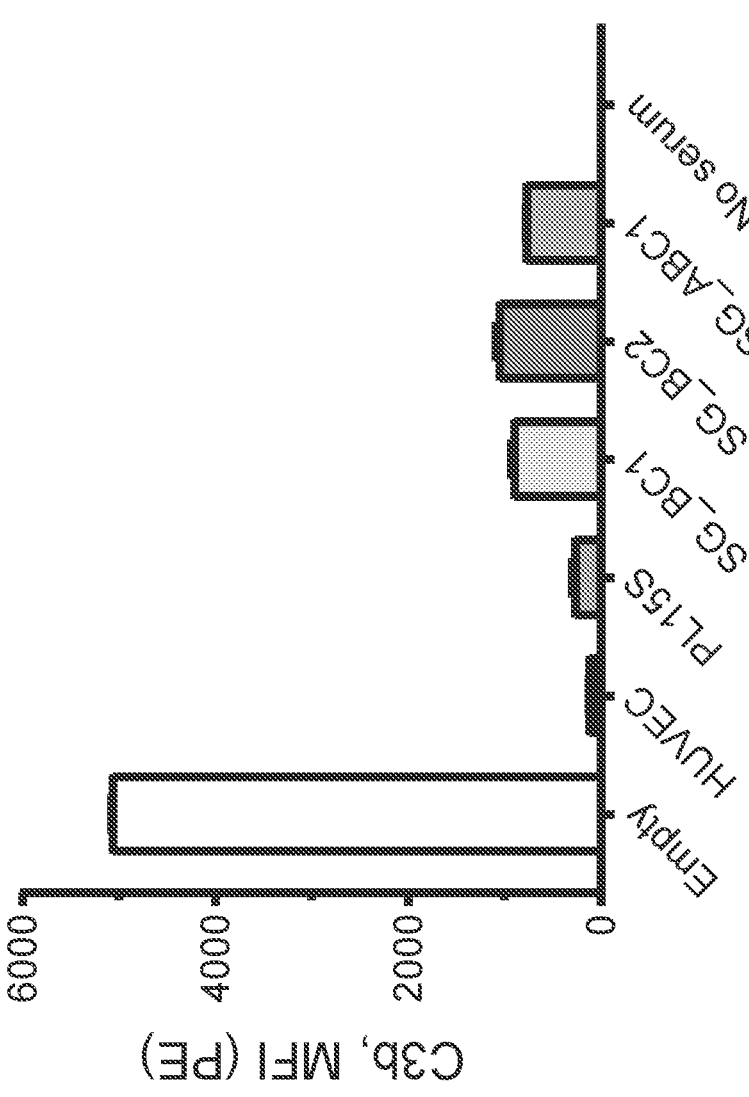
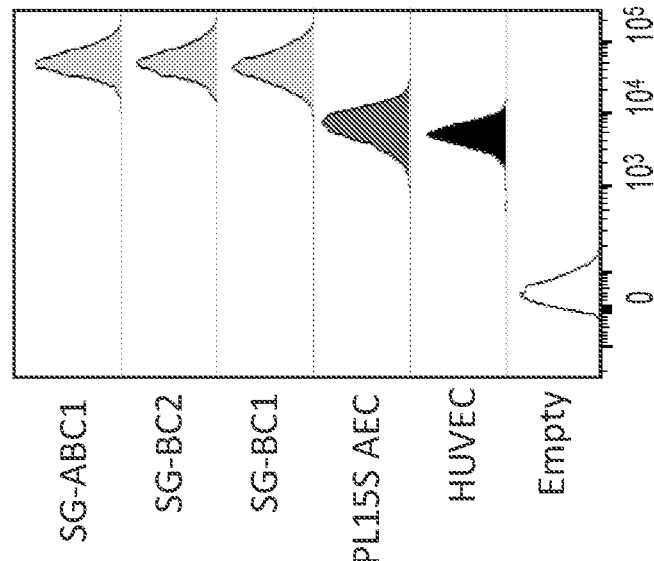

FIG. 21A

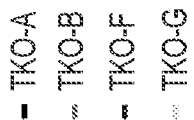
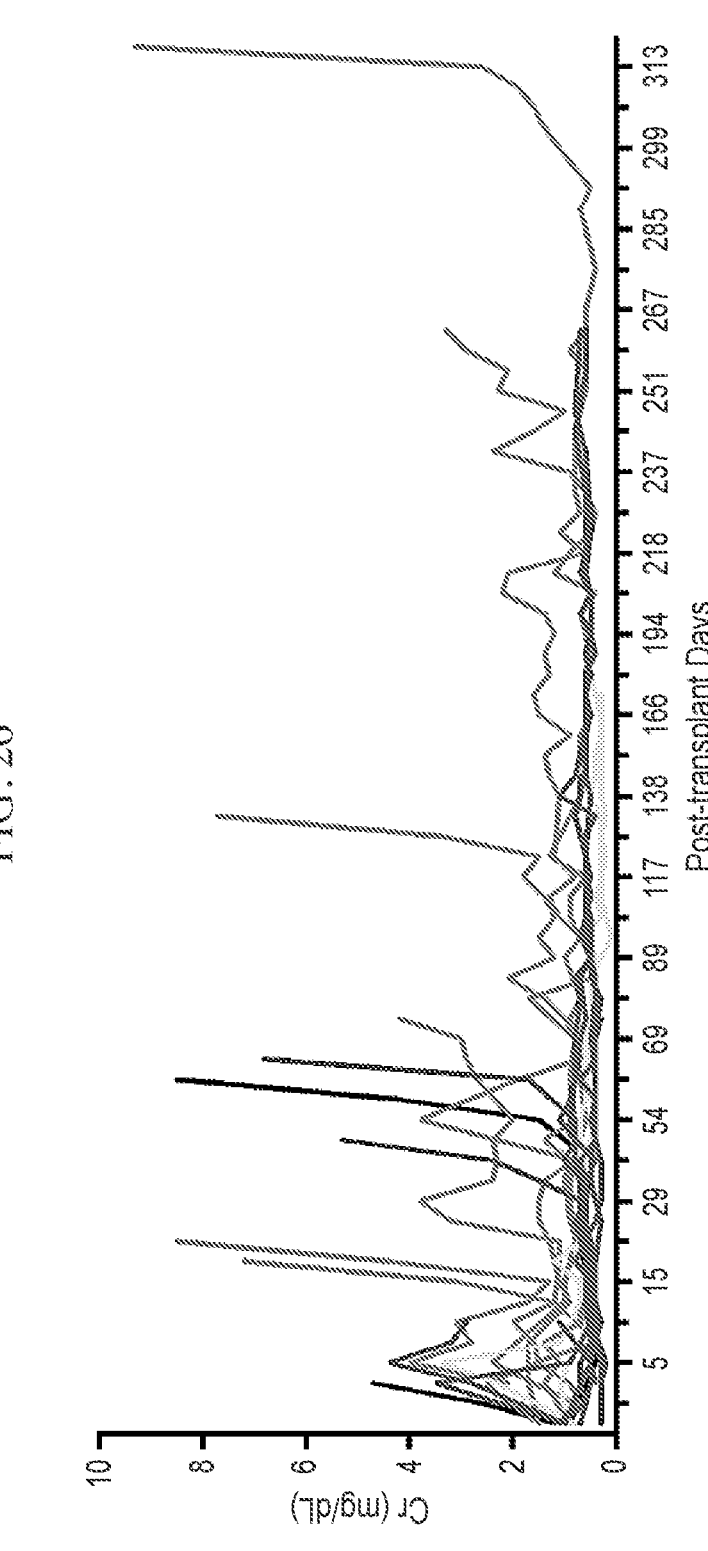
FIG. 26

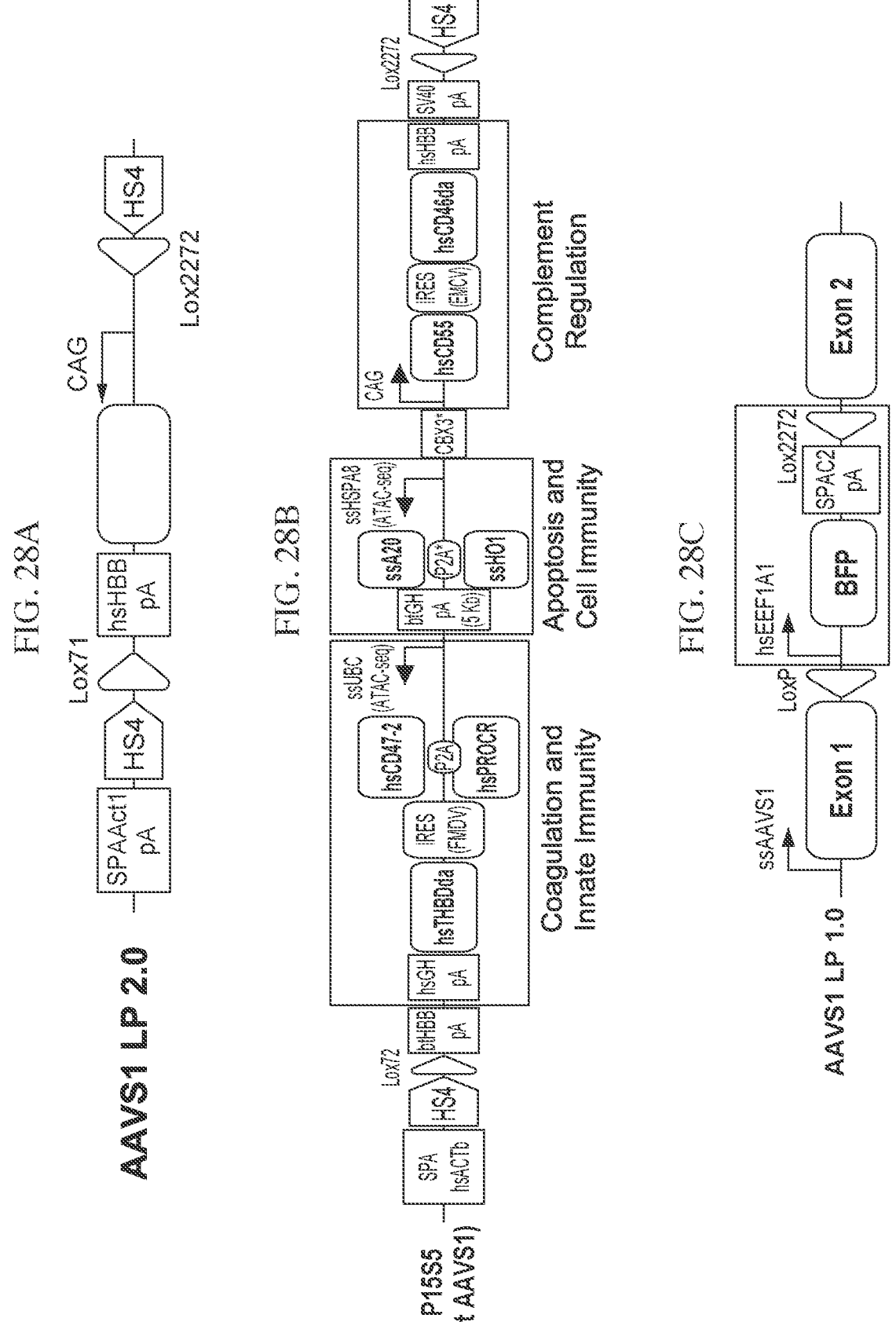

Fig. 43C

CD46 TG expression:

Fetal:
Equivalent signal in glomeruli and tubules

Strong blood vessel signal (ECs + mural cells)

Neonatal:
Very prominent glomerular and blood vessel staining

Adult:
Very intense signal in tubules

CD55 TG expression:

Fetal:
Equivalent signal in glomeruli and tubules

Strong blood vessel signal (ECs + mural cells)

Neonatal:
Very prominent glomerular and blood vessel staining

Strong signal in tubules

Adult:
Signal detected in tubules (but not as high as CD46 and CD47)

CD46    CD55    CD55    Rb-HRP

Rb-HRP

CD46 WT lg (adult)    CD55 WT lg (adult)    WT lg (adult)    Rb-HRP WT lg (adult)

Fetal harvest

Neonate (1d-old)

Adult (4 mo old)

Developmental stage

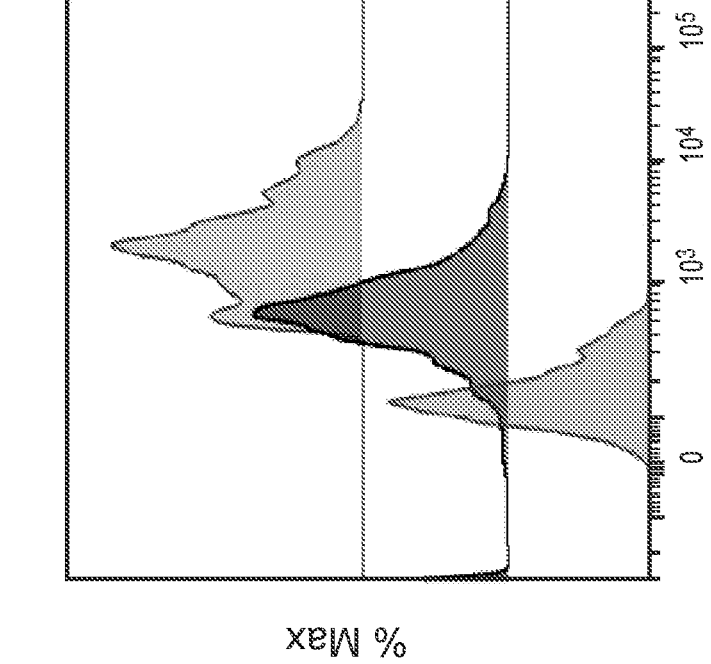
FIG. 44
% Max
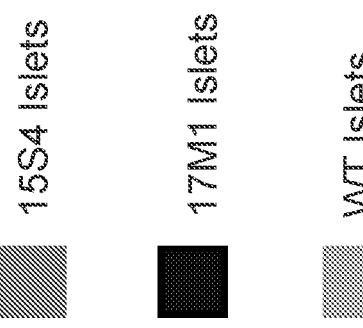
15S4 Islets
17M1 Islets
WT Islets

FIG. 47A

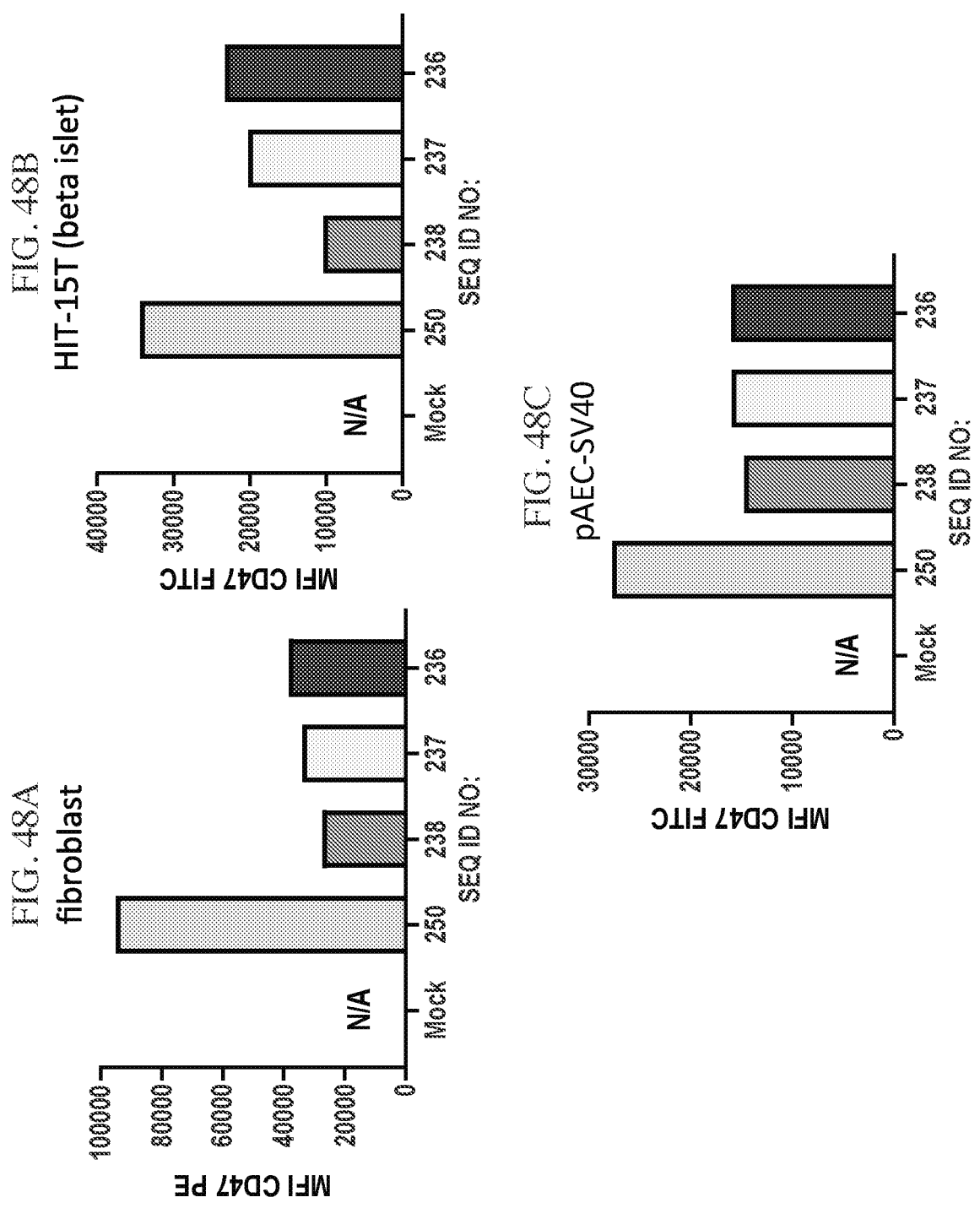

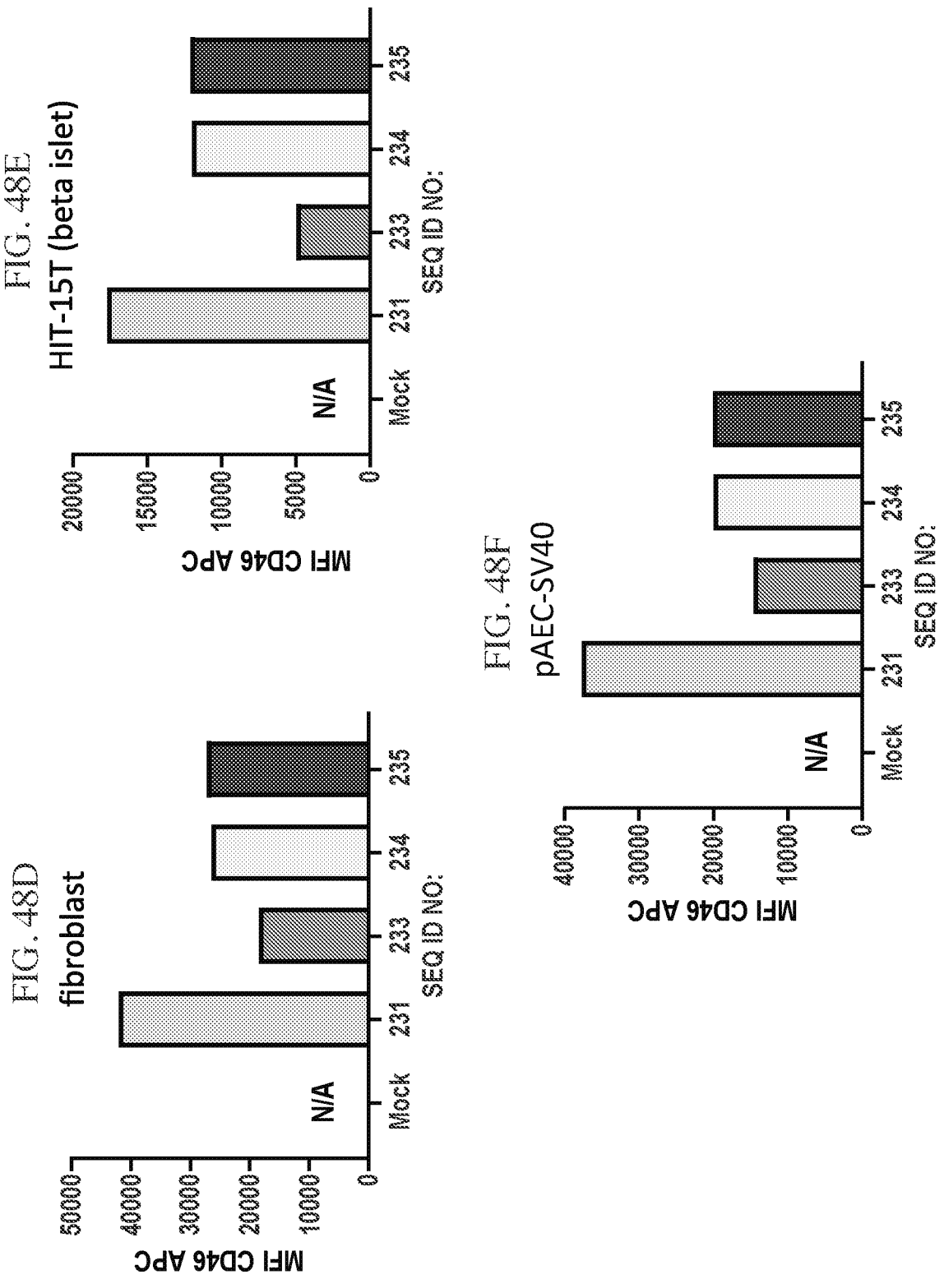

[INSULIN|GLUCAGON|NUCLEI]

Mouse 9

Mouse 8

Mouse 7

Mouse 3

Mouse 2

Mouse 1

Negative controls: 2° antibody only

Txp Date: 2/24/21 6K 17M1 NICC
STZ on 6/24/2021, 16 weeks post txp

FIG. 55

Transgene Protein Surface Expression
Humna CD47

WT EPDCs
DKO EPDCs
PL15S FFs

CD47

Phagocytosis Index

CELLS, TISSUES, ORGANS, AND ANIMALS HAVING ONE OR MORE MODIFIED GENES FOR ENHANCED XENOGRAFT SURVIVAL AND TOLERANCE

CROSS-REFERENCE TO RELATED APPLICATIONS

This application is a continuation of International Application No. PCT/US2021/59265 filed on Nov. 12, 2021, and claims the benefit of priority to U.S. Provisional Application No. 63/113,650, filed on Nov. 13, 2020; U.S. Provisional Application No. 63/218,080, filed on Jul. 2, 2021; and U.S. Provisional Application No. 63/247,544, filed on Sep. 23, 2021. Each of the aforementioned applications is incorporated by reference herein in its entirety.

REFERENCE TO A SEQUENCE LISTING XML

This application contains a Sequence Listing which has been submitted electronically in XML format. The Sequence Listing XML is incorporated herein by reference. Said XML file, created on May 31, 2023, is named 65262-717.301_SL.xml and is 2,167,569 bytes in size.

DESCRIPTION OF THE TEXT FILE SUBMITTED ELECTRONICALLY

The contents of the text file submitted electronically herewith are incorporated herein by reference in their entirety: A computer readable format copy of the Sequence Listing (filename: EGEN_023_03WO_SeqList_ST25.txt, date recorded: Nov. 12, 2021, file size ~2.35 megabyte).

BACKGROUND

The shortage of human organs and tissues for transplantation has grown over the last several decades and represents one of the most significant unmet medical needs. Xenotransplantation has the potential to provide an almost unlimited supply of transplant organs for patients with chronic organ failure. Similarities in organ size and physiology, coupled with genetic engineering to eliminate molecular incompatibilities, makes the pig the donor of choice for renal xenograft. Preclinical studies have demonstrated that porcine renal xenografts have supported life for weeks to months in non-human primate recipients (Higginbotham 2015, Iwase 2015b). However, as a result of the evolutionary distance between pigs and humans, porcine organs trigger rejection by the human immune system in a number of forms, including (i) hyperacute rejection, (ii) acute humoral rejection consisting of disordered thromboregulation and type II endothelial cell (EC) activation with leukocyte recruitment, (iii) thrombotic microangiopathy consisting of intravascular thrombosis with platelet consumption and EC activation, fibrin deposition, and thrombosis due to lack of thromboregulation, and (iv) chronic vasculopathy. These adverse events are due, at least in part, to molecular incompatibilities between the donor and the recipient, particularly with regard to genes involved in complement, coagulation, inflammatory, and immune response systems. The clinical use of xeno-organs (e.g., porcine) has been hindered by these immunological incompatibilities, which have thus far prevented the use of porcine cells, tissue, and vascularized porcine organs in clinical xenotransplantation.

Over the last two decades, several genetic modifications that diminish inter-species incompatibility between porcine and humans have been identified. However, these previously identified genetic modifications have not achieved long-term xenograft survival. Moreover, technical limitations with large-scale genome engineering have hindered the integration of these modifications in a single animal.

SUMMARY

There is a need for developing porcine cells, tissues, organs, and/or porcine animals having a novel combination of gene modifications for use in xenotransplantation and for developing associated methods.

The present disclosure provides cells, tissues, organs, and animals comprising genetic modifications that result in enhanced immunological compatibility, as well as vectors and methods for use in generating these cells, tissues, organs, and animals, and the use of these cells, tissues, organs, and animals in xenotransplantation.

The genetic modifications improve compatibility of the xenotransplants by several modifications that are introduced into the pig. The modifications eliminate expression of antigens know to stimulate anti-graft responses from the host. In addition, over-expression of proteins helps to regulate additional responses to the graft to optimize graft survival in the transplanted host. Disclosed herein are cassettes that express proteins that provide control over host responses. The cassettes may be used in combinations in nucleic acids, also referred to herein as payloads, that are introduced into the genome of the pig.

The payloads may contain a coagulation cassette that expresses multiple proteins that can each regulate one or more aspects of the host coagulation response. For example, the expressed proteins that reduce or eliminate coagulation related to the graft may include THBD and TFPI. THBD reduces blood coagulation by converting thrombin from a procoagulant enzyme to an anticoagulant enzyme. TFPI blocks the initiation of blood coagulation by inhibiting Factor VIIa and prothrombinase.

The payloads may contain a complement regulation cassette that expresses multiple proteins that can each regulate one or more aspects of the host complement response, reducing complement deposition and thus reducing the anti-graft immune response. The expressed proteins to reduce or eliminate complement deposition on the graft may include CD46, CD55, or CD59. CD46 is a cofactor that assists with inactivation of complement components C3b and C4b by serum factor I. By limiting amplification of convertases of the complement cascade, CD55 indirectly blocks formation of the membrane attack complex. The membrane attack complex is formed on the surface of cell membranes after complement activation and enables complement-mediated cell lysis. CD59 prevents C9 from polymerizing and forming the membrane attack complex.

The payloads may contain an innate immunity cassette that reduces the innate immune response of the host against the graft. The expressed proteins to inhibit innate immune attacks against the graft may include B2M, HLA-E, and CD47. B2M and HLA-E reduce natural killer (NK) cell mediated lysis of graft cells. CD47 inhibits macrophage phagocytosis. Optionally, a cassette may be an innate immunity and inflammation cassette and express, in addition to the innate immunity-regulating components, additional proteins that reduce inflammation; for example A20 and HO1. A20 reduces NF-κB activation in response to external stimuli. HO1 prevents vascular inflammation by cleaving heme groups leading to the generation of biliverdin, carbon monoxide, and the release of ferrous iron.

Provided herein is a nucleic acid comprising one or more polycistronic cassettes selected from the group consisting of:

(a) a coagulation cassette comprising: (i) a first cistron encoding THBD wherein the nucleic acid sequence of THBD is selected from the group consisting of SEQ ID NOS: 97-102, 166, and 265-266; (ii) a second cistron encoding TFPI wherein the nucleic acid sequence of TFPI is selected from the group consisting of SEQ ID NOS: 94-96, 103, and 187; (iii) a promoter selected from SEQ ID NOS: 126-145 and 167-168; (iv) a poly A sequence selected from SEQ ID NOS. 112-125, 154-156, 159-162, 190-192, and 239-240, and combinations thereof; (v) at least one 2A polypeptide having a sequence selected from SEQ ID NOS: 1-10, 12-14, and 159-162;

(b) a complement regulation cassette comprising: (i) a first cistron encoding CD46 wherein the nucleic acid sequence of CD46 is selected from the group consisting of SEQ ID NOS: 71-76, 185, 200, 253-258, 262-264; (ii) a second cistron encoding CD59 wherein the nucleic acid sequence of CD59 is selected from the group consisting of SEQ ID NOS: 86, 108; (iii) a promoter selected from SEQ ID NOS: 126-145, 167-168, 178-179, 231-238, and 250; (iv) a poly A sequence selected from SEQ ID NOS. 112-125, 154-156, 159-162, 190-192, and 239-240, and combinations thereof; (v) at least one 2A polypeptide having a sequence selected from SEQ ID NOS: 1-10, 12-14, and 159-162; and (c) an innate immunity cassette comprising: (i) a first cistron encoding a B2M HLA-E fusion protein wherein the nucleic acid sequence encoding the B2M HLA-E fusion protein is selected from the group consisting of SEQ ID NOS: 62, 66, 105; (ii) a second cistron encoding CD47 wherein the nucleic acid sequence of CD47 is selected from the group consisting of SEQ ID NOS: 77-83, 180, and 259; (iii) a promoter selected from SEQ ID NOS: 126-145, 167-168, 178-179, 231-238, and 250; (iv) a poly A sequence selected from SEQ ID NOS. 112-125, 154-156, 159-162, 190-192, and 239-240, and combinations thereof; and (v) at least one 2A polypeptide having a sequence selected from SEQ ID NOS: 1-10, 12-14, and 159-162.

In embodiments, the nucleic acid comprises at least two of the polycistronic cassettes. In embodiments, the nucleic acid comprises three of the polycistronic cassettes. In embodiments, the nucleic acid comprises a sequence selected from the group consisting of SEQ ID NOS: 24, 25, 29, 202, 203, and 207.

Provided herein are nucleic acids comprising one or more polycistronic cassettes selected from the group consisting of:

(a) a coagulation cassette comprising: (i) a first cistron encoding THBD wherein the nucleic acid sequence of THBD is selected from the group consisting of SEQ ID NOS: 97-102, 166, and 265-266; (ii) a second cistron encoding TFPI wherein the nucleic acid sequence of TFPI is selected from the group consisting of SEQ ID NOS: 94-96, 103, and 187; (iii) a promoter selected from SEQ ID NOS: 126-145, 167-168, 178-179, 231-238, and 250; (iv) a poly A sequence selected from SEQ ID NOS. 112-125, 154-156, 159-162, 190-192, and 239-240, and combinations thereof; (v) at least one 2A polypeptide having a sequence selected from SEQ ID NOS: 1-10, 12-14, and 159-162;

(b) a complement regulation cassette comprising: (i) a first cistron encoding CD46 wherein the nucleic acid sequence of CD46 is selected from the group consisting of SEQ ID NOS: 71-76, 185, 200, 253-258, 262-264; (ii) a second cistron encoding CD59 wherein the nucleic acid sequence of CD59 is selected from the group consisting of SEQ ID NOS: 86, 108; (iii) a promoter selected from SEQ ID NOS: 126-145, 167-168, 178-179, 231-238, and 250; (iv) a poly A sequence selected from SEQ ID NOS. 112-125, 154-156, 159-162, 190-192, and 239-240, and combinations thereof; (v) at least one 2A polypeptide having a sequence selected from SEQ ID NOS: 1-10, 12-14, and 159-162; and (c) an innate immunity and inflammation and apoptosis cassette comprising: (i) a first cistron encoding a B2M HLA-E fusion protein wherein the nucleic acid sequence encoding the B2M HLA-E fusion protein is selected from the group consisting of SEQ ID NOS: 62, 66, 105; (ii) a second cistron encoding CD47 wherein the nucleic acid sequence of CD47 is selected from the group consisting of SEQ ID NOS: 77-83, 180, and 259; (iii) a third cistron encoding A20 wherein the nucleic acid sequence of A20 is selected from the group consisting of SEQ ID NOS: 64-65, 104, 182, and 188; (iv) a fourth cistron encoding HO1 wherein the nucleic acid sequence of HO1 is selected from the group consisting of SEQ ID NOS: 63, 109, 165, 183, and 189; (v) a promoter selected from SEQ ID NOS: 126-145, 167-168, 178-179, 231-238, and 250; (vi) a poly A sequence selected from SEQ ID NOS. 112-125, 154-156, 159-162, 190-192, and 239-240, and combinations thereof; and (vi) at least one 2A polypeptide having a sequence selected from SEQ ID NOS: 1-10, 12-14, and 159-162.

In embodiments, the nucleic acid comprises at least two of the polycistronic cassettes. In embodiments, the nucleic acid comprises three of the polycistronic cassettes. In embodiments, the nucleic acid comprises a sequence of SEQ ID NO: 26 or SEQ ID NO: 204.

Provided herein are nucleic acids comprising one or more polycistronic cassettes selected from the group consisting of:

(a) a coagulation cassette comprising: (i) a first cistron encoding THBD wherein the nucleic acid sequence of THBD is selected from the group consisting of SEQ ID NOS: 97-102, 166, and 265-266; (ii) a second cistron encoding TFPI wherein the nucleic acid sequence of TFPI is selected from the group consisting of SEQ ID NOS: 94-96, 103, and 187; (iii) a third cistron encoding CD39 wherein the nucleic acid sequence of CD39 is selected from the group consisting of SEQ ID NOS: 67-70 AND SEQ ID NO: 106; (iv) a promoter selected from SEQ ID NOS: 126-145, 167-168, 178-179, 231-238, and 250; and (v) a poly A sequence selected from SEQ ID NOS. 112-125, 154-156, 159-162, 190-192, and 239-240, and combinations thereof; (vi) at least one 2A polypeptide having a sequence selected from SEQ ID NOS: 1-10, 12-14, and 159-162;

(b) a complement regulation cassette comprising: (i) a first cistron encoding CD46 wherein the nucleic acid sequence of CD46 is selected from the group consisting of SEQ ID NOS: 71-76, 185, 200, 253-258, 262-264; (ii) a second cistron encoding CD59 wherein the nucleic acid sequence of CD59 is selected from the group consisting of SEQ ID NOS: 86, 108; (iii) a third cistron encoding CD55 wherein the nucleic acid sequence of CD55 is selected from the group consisting of SEQ ID NOS: 84, 85, 107, and 184; (iv) a promoter selected from SEQ ID NOS: 126-145, 167-168, 178-179, 231-238, and 250; (v) a poly A sequence selected from SEQ ID NOS. 112-125, 154-156, 159-162, 190-192, and 239-240, and combinations thereof; (vi) at least one 2A polypeptide having a sequence selected from SEQ ID NOS: 1-10, 12-14, and 159-162; and (c) an innate immunity and inflammation and apoptosis cassette comprising: (i) a first cistron encoding a B2M HLA-E fusion protein wherein the nucleic acid sequence encoding the B2M HLA-E fusion protein is selected from the group consisting of SEQ ID NOS: 62, 66, 105; (ii) a second cistron encoding CD47 wherein the nucleic acid sequence of CD47 is selected from the group consisting of SEQ ID NOS: 77-83, 180, and 259; (iii) a third cistron encoding A20 wherein the nucleic acid sequence of A20 is selected from the group consisting of SEQ ID NOS: 64-65, 104, 182, and 188; (iv) a fourth cistron encoding HO1 wherein the nucleic acid sequence of HO1 is selected from the group consisting of SEQ ID NOS: 63, 109, 165, 183, and 189; (v) a fifth cistron encoding PD-L1 wherein the nucleic acid sequence of PD-L1 is selected from the group consisting of SEQ ID NOS: 89-91; (vi) a promoter selected from SEQ ID NOS: 126-145, 167-168, 178-179, 231-238, and 250; (vii) a poly A sequence selected from SEQ ID NOS. 112-125, 154-156, 159-162, 190-192, and 239-240, and combinations thereof; and (viii) at least one 2A polypeptide having a sequence selected from SEQ ID NOS: 1-10, 12-14, and 159-162.

In embodiments, the nucleic acid comprises at least two of the polycistronic cassettes. In embodiments, the nucleic acid comprises three of the polycistronic cassettes. In embodiments, the nucleic acid comprises a sequence selected from the group consisting of SEQ ID NOS: 23, 27, 28, 201, 205, and 206.

Provided herein are nucleic acids comprising one or more polycistronic cassettes selected from the group consisting of:

(a) a coagulation cassette comprising: (i) a first cistron encoding THBD wherein the nucleic acid sequence of THBD is selected from the group consisting of SEQ ID NOS: 97-102, 166, and 265-266; (ii) a second cistron encoding PROCR wherein the nucleic acid sequence of PROCR is selected from the group consisting of SEQ ID NOS: 92, 93, and 181; (iii) a promoter selected from SEQ ID NOS: 126-145, 167-168, 178-179, 231-238, and 250; (iv) a poly A sequence selected from SEQ ID NOS. 112-125, 154-156, 159-162, 190-192, and 239-240, and combinations thereof; (v) at least one 2A polypeptide having a sequence selected from SEQ ID NOS: 1-10, 12-14, and 159-162;

(b) an inflammation and apoptosis cassette comprising: (i) a first cistron encoding A20 wherein the nucleic acid sequence of A20 is selected from the group consisting of SEQ ID NOS: 64-65, 104, 182, and 188; (ii) a second cistron encoding HO1 wherein the nucleic acid sequence of HO1 is selected from the group consisting of SEQ ID NOS: 63, 109, 165, 183, and 189; (iii) a promoter selected from SEQ ID NOS: 126-145, 167-168, 178-179, 231-238, and 250; and (iv) a poly A sequence selected from SEQ ID NOS. 112-125, 154-156, 159-162, 190-192, and 239-240, and combinations thereof; (v) at least one 2A polypeptide having a sequence selected from SEQ ID NOS: 1-10, 12-14, and 159-162; and (c) a complement regulation and innate immunity cassette comprising: (i) a first cistron encoding CD46 wherein the nucleic acid sequence of CD46 is selected from the group consisting of SEQ ID NOS: 71-76, 185, 200, 253-258, 262-264; (ii) a second cistron encoding CD47 wherein the nucleic acid sequence of CD47 is selected from the group consisting of SEQ ID NOS: 77-83, 180, and 259; (iii) a third cistron encoding CD55 wherein the nucleic acid sequence of CD55 is selected from the group consisting of SEQ ID NOS: 84, 85, 107, and 184; (iv) a promoter selected from SEQ ID NOS: 126-145, 167-168, 178-179, 231-238, and 250; (v) a poly A sequence selected from SEQ ID NOS. 112-125, 154-156, 159-162, 190-192, and 239-240, and combinations thereof; and (vi) at least one 2A polypeptide having a sequence selected from SEQ ID NOS: 1-10, 12-14, and 159-162.

In embodiments, nucleic acids disclosed herein comprise at least two of the polycistronic cassettes. In embodiments, nucleic acids comprise three of the polycistronic cassettes. In embodiments, the nucleic acid comprises a sequence of SEQ ID NO: 30 or SEQ ID NO: 208.

Provided herein are nucleic acids comprising one or more polycistronic cassettes selected from the group consisting of:

(a) a coagulation cassette comprising: (i) a first cistron encoding THBD wherein the nucleic acid sequence of THBD is selected from the group consisting of SEQ ID NOS: 97-102, 166, and 265-266; (ii) a second cistron encoding PROCR wherein the nucleic acid sequence of PROCR is selected from the group consisting of SEQ ID NOS: 92, 93, and 181; (iii) a third cistron encoding TFPI wherein the nucleic acid sequence of TFPI is selected from the group consisting of SEQ ID NOS: 94-96, 103, and 187; (iv) a promoter selected from SEQ ID NOS: 126-145, 167-168, 178-179, 231-238, and 250; (v) a poly A sequence selected from SEQ ID NOS. 112-125, 154-156, 159-162, 190-192, and 239-240, and combinations thereof; (vi) at least one 2A polypeptide having a sequence selected from SEQ ID NOS: 1-10, 12-14, and 159-162;

(b) a complement regulation cassette comprising: (i) a first cistron encoding CD46 wherein the nucleic acid sequence of CD46 is selected from the group consisting of SEQ ID NOS: 71-76, 185, 200, 253-258, 262-264; (ii) a third cistron encoding CD55 wherein the nucleic acid sequence of CD55 is selected from the group consisting of SEQ ID NOS: 84, 85, 107, and 184; (iii) a promoter selected from SEQ ID NOS: 126-145, 167-168, 178-179, 231-238, and 250; (iv) a poly A sequence selected from SEQ ID NOS. 112-125, 154-156, 159-162, 190-192, and 239-240, and combinations thereof; (v) at least one 2A polypeptide having a sequence selected from SEQ ID NOS: 1-10, 12-14, and 159-162; and (c) an innate immunity cassette comprising: (i) a first cistron encoding a B2M HLA-E fusion protein wherein the nucleic acid sequence encoding the B2M HLA-E fusion protein is selected from the group consisting of SEQ ID NOS: 62, 66, 105; (ii) a second cistron encoding CD47 wherein the nucleic acid sequence of CD47 is selected from the group consisting of SEQ ID NOS: 77-83, 180, and 259; (iii) a promoter selected from SEQ ID NOS: 126-145, 167-168, 178-179, 231-238, and 250; (iv) a poly A sequence selected from SEQ ID NOS. 112-125, 154-156, 159-162, 190-192, and 239-240, and combinations thereof; and (v) at least one 2A polypeptide having a sequence selected from SEQ ID NOS: 1-10, 12-14, and 159-162.

In embodiments, the aforementioned nucleic acid comprises at least two of the aforementioned polycistronic cassettes. In embodiments, the aforementioned nucleic acid comprises three of the aforementioned polycistronic cassettes. In embodiments, the nucleic acid comprises a sequence selected from the group consisting of SEQ ID NOS: 31-34 and 209-212.

Provided herein are nucleic acids comprising one or more polycistronic cassettes selected from the group consisting of:
- (a) a coagulation cassette comprising: (i) a first cistron encoding THBD wherein the nucleic acid sequence of THBD is selected from the group consisting of SEQ ID NOS: 97-102, 166, and 265-266; (ii) a second cistron encoding PROCR wherein the nucleic acid sequence of PROCR is selected from the group consisting of SEQ ID NOS: 92, 93, and 181; (iii) a promoter selected from SEQ ID NOS: 126-145, 167-168, 178-179, 231-238, and 250; (iv) a poly A sequence selected from SEQ ID NOS. 112-125, 154-156, 159-162, 190-192, and 239-240, and combinations thereof; (v) at least one 2A polypeptide having a sequence selected from SEQ ID NOS: 1-10, 12-14, and 159-162;
- (b) a complement regulation cassette comprising: (i) a first cistron encoding CD46 wherein the nucleic acid sequence of CD46 is selected from the group consisting of SEQ ID NOS: 71-76, 185, 200, 253-258, 262-264; (ii) a third cistron encoding CD55 wherein the nucleic acid sequence of CD55 is selected from the group consisting of SEQ ID NOS: 84, 85, 107, and 184; (iii) a promoter selected from SEQ ID NOS: 126-145, 167-168, 178-179, 231-238, and 250; (iv) a poly A sequence selected from SEQ ID NOS. 112-125, 154-156, 159-162, 190-192, and 239-240, and combinations thereof; (v) at least one 2A polypeptide having a sequence selected from SEQ ID NOS: 1-10, 12-14, and 159-162, and
- (c) an innate immunity and inflammation and apoptosis cassette comprising: (i) a first cistron encoding a B2M HLA-E fusion protein wherein the nucleic acid sequence encoding the B2M HLA-E fusion protein is selected from the group consisting of SEQ ID NOS: 62, 66, 105; (ii) a second cistron encoding CD47 wherein the nucleic acid sequence of CD47 is selected from the group consisting of SEQ ID NOS: 77-83, 180, and 259; (iii) a third cistron encoding A20 wherein the nucleic acid sequence of A20 is selected from the group consisting of SEQ ID NOS: 64-65, 104, 182, and 188; (iv) a fourth cistron encoding HO1 wherein the nucleic acid sequence of HO1 is selected from the group consisting of SEQ ID NOS: 63, 109, 165, 183, and 189; (v) a promoter selected from SEQ ID NOS: 126-145, 167-168, 178-179, 231-238, and 250; and (vi) a poly A sequence selected from SEQ ID NOS. 112-125, 154-156, 159-162, 190-192, and 239-240, and combinations thereof, and (vii) at least one 2A polypeptide having a sequence selected from SEQ ID NOS: 1-10, 12-14, and 159-162.

In embodiments, the aforementioned nucleic acid comprises at least two of the aforementioned polycistronic cassettes. In embodiments, the aforementioned nucleic acid comprises three of the aforementioned polycistronic cassettes. In embodiments, the nucleic acid comprises a sequence of SEQ ID NO: 37 or SEQ ID NO: 215.

Provided herein are nucleic acids comprising one or more polycistronic cassettes selected from the group consisting of:
- (a) a coagulation cassette comprising: (i) a first cistron encoding THBD wherein the nucleic acid sequence of THBD is selected from the group consisting of SEQ ID NOS: 97-102, 166, and 265-266; (ii) a second cistron encoding TFPI wherein the nucleic acid sequence of TFPI is selected from the group consisting of SEQ ID NOS: 94-96, 103, and 187; (iii) a third cistron encoding CD39 wherein the nucleic acid sequence of CD39 is selected from the group consisting of SEQ ID NOS: 67-70 AND SEQ ID NO: 106; (iv) a promoter selected from SEQ ID NOS: 126-145, 167-168, 178-179, 231-238, and 250; (v) a poly A sequence selected from SEQ ID NOS. 112-125, 154-156, 159-162, 190-192, and 239-240, and combinations thereof; (vi) at least one 2A polypeptide having a sequence selected from SEQ ID NOS: 1-10, 12-14, and 159-162;
- (b) a complement regulation and inflammation and apoptosis cassette comprising: (i) a first cistron encoding CD46 wherein the nucleic acid sequence of CD46 is selected from the group consisting of SEQ ID NOS: 71-76, 185, 200, 253-258, 262-264; (ii) a second cistron encoding CD59 wherein the nucleic acid sequence of CD59 is selected from the group consisting of SEQ ID NOS: 86, 108; (iii) a third cistron encoding CD55 wherein the nucleic acid sequence of CD55 is selected from the group consisting of SEQ ID NOS: 84, 85, 107, and 184; (iv) a fourth cistron encoding A20 wherein the nucleic acid sequence of A20 is selected from the group consisting of SEQ ID NOS: 64-65, 104, 182, and 188; (v) a fifth cistron encoding HO1 wherein the nucleic acid sequence of HO1 is selected from the group consisting of SEQ ID NOS: 63, 109, 165, 183, and 189; (vi) a sixth cistron encoding PD-L1 wherein the nucleic acid sequence of PD-L1 is selected from the group consisting of SEQ ID NOS: 89-91; (vii) a promoter selected from SEQ ID NOS: 126-145, 167-168, 178-179, 231-238, and 250; (viii) a poly A sequence selected from SEQ ID NOS. 112-125, 154-156, 159-162, 190-192, and 239-240, and combinations thereof; (ix) at least one 2A polypeptide having a sequence selected from SEQ ID NOS: 1-10, 12-14, and 159-162, and
- (c) an innate immunity cassette comprising: (i) a first cistron encoding a B2M HLA-E fusion protein wherein the nucleic acid sequence encoding the B2M HLA-E fusion protein is selected from the group consisting of SEQ ID NOS: 62, 66, 105; (ii) a second cistron encoding CD47 wherein the nucleic acid sequence of CD47 is selected from the group consisting of SEQ ID NOS: 77-83, 180, and 259; (iii) a promoter selected from SEQ ID NOS: 126-145, 167-168, 178-179, 231-238, and 250; (iv) a poly A sequence selected from SEQ ID NOS. 112-125, 154-156, 159-162, 190-192, and 239-240, and combinations thereof; and (v) at least one 2A polypeptide having a sequence selected from SEQ ID NOS: 1-10, 12-14, and 159-162.

In embodiments, the aforementioned nucleic acid comprises at least two of the aforementioned polycistronic cassettes. In embodiments, the aforementioned nucleic acid comprises three of the aforementioned polycistronic cassettes. In embodiments, the nucleic acid comprises a sequence of SEQ ID NO: 35 or SEQ ID NO: 213.

Provided herein are nucleic acids comprising one or more polycistronic cassettes selected from the group consisting of:
- (a) a coagulation cassette comprising: (i) a first cistron encoding THBD wherein the nucleic acid sequence of THBD is selected from the group consisting of SEQ ID NOS: 97-102, 166, and 265-266; (ii) a second cistron encoding TFPI wherein the nucleic acid sequence of TFPI is selected from the group consisting of SEQ ID NOS: 94-96, 103, and 187; (iii) a promoter selected from SEQ ID NOS: 126-145, 167-168, 178-179, 231-238, and 250; (iv) a poly A sequence selected from SEQ ID NOS. 112-125, 154-156, 159-162, 190-192, and 239-240, and combinations thereof; and (v) at least one 2A polypeptide having a sequence selected from SEQ ID NOS: 1-10, 12-14, and 159-162;

(b) a complement regulation cassette comprising: (i) a first cistron encoding CD46 wherein the nucleic acid sequence of CD46 is selected from the group consisting of SEQ ID NOS: 71-76, 185, 200, 253-258, 262-264; (ii) a third cistron encoding CD55 wherein the nucleic acid sequence of CD55 is selected from the group consisting of SEQ ID NOS: 84, 85, 107, and 184; (iii) a promoter selected from SEQ ID NOS: 126-145, 167-168, 178-179, 231-238, and 250; (iv) a poly A sequence selected from SEQ ID NOS. 112-125 and, 154-156, 159-162, 190-192, and combinations thereof; (v) at least one 2A polypeptide having a sequence selected from SEQ ID NOS: 1-10, 12-14, and 159-162, and (c) an innate immunity cassette comprising: (i) a first cistron encoding a B2M HLA-E fusion protein wherein the nucleic acid sequence encoding the B2M HLA-E fusion protein is selected from the group consisting of SEQ ID NOS: 62, 66, 105; (ii) a second cistron encoding CD47 wherein the nucleic acid sequence of CD47 is selected from the group consisting of SEQ ID NOS: 77-83, 180, and 259; (iii) a promoter selected from SEQ ID NOS: 126-145, 167-168, 178-179, 231-238, and 250; (iv) a poly A sequence selected from SEQ ID NOS. 112-125 and, 154-156, 159-162, 190-192, and combinations thereof, and (v) at least one 2A polypep-tide having a sequence selected from SEQ ID NOS: 1-10, 12-14, and 159-162.

In embodiments, the aforementioned nucleic acid com-prises at least two of the aforementioned polycistronic cassettes. In embodiments, the aforementioned nucleic acid comprises three of the aforementioned polycistronic cas-settes. In embodiments, the nucleic acid comprises a sequence selected from the group consisting of SEQ ID NOS: 36, 40, 214, and 218.

Provided herein are nucleic acids comprising one or more polycistronic cassettes selected from the group consisting of:

(a) a coagulation cassette comprising: (i) a first cistron encoding THBD wherein the nucleic acid sequence of THBD is selected from the group consisting of SEQ ID NOS: 97-102, 166, and 265-266; (ii) a second cistron encoding TFPI wherein the nucleic acid sequence of TFPI is selected from the group consisting of SEQ ID NOS: 94-96, 103, and 187; (iii) a promoter selected from SEQ ID NOS: 126-145, 167-168, 178-179, 231-238, and 250; and (iv) a poly A sequence selected from SEQ ID NOS. 112-125 and, 154-156, 159-162, 190-192, and combinations thereof; (v) at least one 2A polypeptide having a sequence selected from SEQ ID NOS: 1-10, 12-14, and 159-162;

(b) a complement regulation and inflammation and apop-tosis cassette comprising: (i) a first cistron encoding CD46 wherein the nucleic acid sequence of CD46 is selected from the group consisting of SEQ ID NOS: 71-76, 185, 200, 253-258, 262-264; (ii) a second cis-tron encoding CD55 wherein the nucleic acid sequence of CD55 is selected from the group consisting of SEQ ID NOS: 84, 85, 107, and 184; (iii) a third cistron encoding A20 wherein the nucleic acid sequence of A20 is selected from the group consisting of SEQ ID NOS: 64-65, 104, 182, and 188; (iv) a fourth cistron encoding HO1 wherein the nucleic acid sequence of HO1 is selected from the group consisting of SEQ ID NOS: 63, 109, 165, 183, and 189; (v) a promoter selected from SEQ ID NOS: 126-145, 167-168, 178-179, 231-238, and 250; and (vi) a poly A sequence selected from SEQ ID NOS. 112-125 and, 154-156, 159-162, 190-192, and combinations thereof; (vii) at least one 2A polypeptide having a sequence selected from SEQ ID NOS: 1-10, 12-14, and 159-162; and (c) an innate immunity cassette comprising: (i) a first cistron encoding a B2M HLA-E fusion protein wherein the nucleic acid sequence encoding the B2M HLA-E fusion protein is selected from the group consisting of SEQ ID NOS: 62, 66, 105; (ii) a second cistron encoding CD47 wherein the nucleic acid sequence of CD47 is selected from the group consisting of SEQ ID NOS: 77-83, 180, and 259; (iii) a promoter selected from SEQ ID NOS: 126-145, 167-168, 178-179, 231-238, and 250; (iv) a poly A sequence selected from SEQ ID NOS. 112-125 and, 154-156, 159-162, 190-192, and combinations thereof; and (v) at least one 2A polypep-tide having a sequence selected from SEQ ID NOS: 1-10, 12-14, and 159-162.

In embodiments, the aforementioned nucleic acid com-prises at least two of the aforementioned polycistronic cassettes. In embodiments, the aforementioned nucleic acid comprises three of the aforementioned polycistronic cas-settes. In embodiments, the nucleic acid comprises a sequence selected from the group consisting of SEQ ID NOS: 41, 42, 219, and 220.

Provided herein are nucleic acids comprising one or more polycistronic cassettes selected from the group consisting of:

(a) a coagulation cassette comprising: (i) a first cistron encoding THBD wherein the nucleic acid sequence of THBD is selected from the group consisting of SEQ ID NOS: 97-102, 166, and 265-266; (ii) a second cistron encoding TFPI wherein the nucleic acid sequence of TFPI is selected from the group consisting of SEQ ID NOS: 94-96, 103, and 187; (iii) a third cistron encoding CD39 wherein the nucleic acid sequence of CD39 is selected from the group consisting of SEQ ID NOS: 67-70 AND SEQ ID NO: 106; (iv) a promoter selected from SEQ ID NOS: 126-145, 167-168, 178-179, 231-238, and 250; (v) a poly A sequence selected from SEQ ID NOS. 112-125 and, 154-156, 159-162, 190-192, and combinations thereof; (vi) at least one 2A polypeptide having a sequence selected from SEQ ID NOS: 1-10, 12-14, and 159-162, (b) a complement regulation and inflammation and apop-tosis cassette comprising: (i) a first cistron encoding CD46 wherein the nucleic acid sequence of CD46 is selected from the group consisting of SEQ ID NOS: 71-76, 185, 200, 253-258, 262-264; (ii) a second cis-tron encoding CD59 wherein the nucleic acid sequence of CD59 is selected from the group consisting of SEQ ID NOS: 86, 108; (iii) a third cistron encoding CD55 wherein the nucleic acid sequence of CD55 is selected from the group consisting of SEQ ID NOS: 84, 85, 107, and 184; (iv) a fourth cistron encoding A20 wherein the nucleic acid sequence of A20 is selected from the group consisting of SEQ ID NOS: 64-65, 104, 182, and 188; (v) a fifth cistron encoding HO1 wherein the nucleic acid sequence of HO1 is selected from the group consisting of SEQ ID NOS: 63, 109, 165, 183, and 189; (vi) a sixth cistron encoding PD-L1 wherein the nucleic acid sequence of PD-L1 is selected from the group consisting of SEQ ID NOS: 89-91; (vii) a promoter selected from SEQ ID NOS: 126-145, 167-168, 178-179, 231-238, and 250; (viii) a poly A sequence selected from SEQ ID NOS. 112-125 and, 154-156, 159-162, 190-192, and combinations thereof; and (ix) at least one 2A polypeptide having a sequence selected from SEQ ID NOS: 1-10, 12-14, and 159-162, and (c) an innate immunity cassette comprising: (i) a first cistron encoding a B2M HLA-E fusion protein wherein the nucleic acid sequence encoding the B2M HLA-E fusion protein is selected from the group consisting of SEQ ID NOS: 62, 66, 105; (ii) a second cistron encoding CD47 wherein the nucleic acid sequence of CD47 is selected from the group consisting of SEQ ID NOS: 77-83, 180, and 259; (iii) a promoter selected from SEQ ID NOS: 126-145, 167-168, 178-179, 231-238, and 250; (iv) a poly A sequence selected from SEQ ID NOS. 112-125 and, 154-156, 159-162, 190-192, and combinations thereof; and (v) at least one 2A polypeptide having a sequence selected from SEQ ID NOS: 1-10, 12-14, and 159-162.

In embodiments, the aforementioned nucleic acid comprises at least two of the aforementioned polycistronic cassettes. In embodiments, the aforementioned nucleic acid comprises three of the aforementioned polycistronic cassettes. In embodiments, the nucleic acid comprises a sequence selected from the group consisting of SEQ ID NOS: 38, 39, 173, 216, 217, and 226.

Provided herein are nucleic acids comprising one or more polycistronic cassettes selected from the group consisting of:

(a) a coagulation cassette comprising: (i) a first cistron encoding THBD wherein the nucleic acid sequence of THBD is selected from the group consisting of SEQ ID NOS: 97-102, 166, and 265-266; (ii) a second cistron encoding TFPI wherein the nucleic acid sequence of TFPI is selected from the group consisting of SEQ ID NOS: 94-96, 103, and 187; (iii) a promoter selected from SEQ ID NOS: 126-145, 167-168, 178-179, 231-238, and 250; (iv) a poly A sequence selected from SEQ ID NOS. 112-125 and, 154-156, 159-162, 190-192, and combinations thereof; and (v) at least one 2A polypeptide having a sequence selected from SEQ ID NOS: 1-10, 12-14, and 159-162;

(b) a complement regulation cassette comprising: (i) a first cistron encoding CD46 wherein the nucleic acid sequence of CD46 is selected from the group consisting of SEQ ID NOS: 71-76, 185, 200, 253-258, 262-264; (ii) a third cistron encoding CD55 wherein the nucleic acid sequence of CD55 is selected from the group consisting of SEQ ID NOS: 84, 85, 107, and 184; (iii) a promoter selected from SEQ ID NOS: 126-145, 167-168, 178-179, 231-238, and 250; (iv) a poly A sequence selected from SEQ ID NOS. 112-125 and, 154-156, 159-162, 190-192, and combinations thereof; (v) at least one 2A polypeptide having a sequence selected from SEQ ID NOS: 1-10, 12-14, and 159-162, (c) an innate immunity cassette comprising: (i) a first cistron encoding a B2M HLA-E fusion protein wherein the nucleic acid sequence encoding the B2M HLA-E fusion protein is selected from the group consisting of SEQ ID NOS: 62, 66, 105; (ii) a second cistron encoding CD47 wherein the nucleic acid sequence of CD47 is selected from the group consisting of SEQ ID NOS: 77-83, 180, and 259; (iii) a promoter selected from SEQ ID NOS: 126-145, 167-168, 178-179, 231-238, and 250; (iv) a poly A sequence selected from SEQ ID NOS. 112-125 and, 154-156, 159-162, 190-192, and combinations thereof, (v) at least one 2A polypeptide having a sequence selected from SEQ ID NOS: 1-10, 12-14, and 159-162; and (d) a cell immunity and coagulation cassette comprising: (i) a first cistron encoding LEA29Y wherein the nucleic acid sequence of LEA29Y is selected from the group consisting of SEQ ID NOS: 87-88, (ii) a second cistron encoding CD39 wherein the nucleic acid sequence of CD39 is selected from the group consisting of SEQ ID NOS: 67-70 AND SEQ ID NO: 106; (iii) a promoter selected from SEQ ID NOS: 126-145, 167-168, 178-179, 231-238, and 250; and (iv) a poly A sequence selected from SEQ ID NOS. 112-125 and, 154-156, 159-162, 190-192, and combinations thereof, and (v) at least one 2A polypeptide having a sequence selected from SEQ ID NOS: 1-10, 12-14, and 159-162.

In embodiments, the aforementioned nucleic acid comprises at least two of the aforementioned polycistronic cassettes. In embodiments, the aforementioned nucleic acid comprises at least three of the aforementioned polycistronic cassettes. In embodiments, the aforementioned nucleic acid comprises four of the aforementioned polycistronic cassettes. In embodiments, the nucleic acid comprises a sequence of SEQ ID NO: 43 or SEQ ID NO: 221.

Provided herein are nucleic acids comprising one or more polycistronic cassettes selected from the group consisting of:

(a) a coagulation cassette comprising: (i) a first cistron encoding THBD wherein the nucleic acid sequence of THBD is selected from the group consisting of SEQ ID NOS: 97-102, 166, and 265-266; (ii) a second cistron encoding TFPI wherein the nucleic acid sequence of TFPI is selected from the group consisting of SEQ ID NOS: 94-96, 103, and 187; (iii) a promoter selected from SEQ ID NOS: 126-145, 167-168, 178-179, 231-238, and 250; (iv) a poly A sequence selected from SEQ ID NOS. 112-125 and, 154-156, 159-162, 190-192, and combinations thereof; (v) at least one 2A polypeptide having a sequence selected from SEQ ID NOS: 1-10, 12-14, and 159-162;

(b) a complement regulation cassette comprising: (i) a first cistron encoding CD46 wherein the nucleic acid sequence of CD46 is selected from the group consisting of SEQ ID NOS: 71-76, 185, 200, 253-258, 262-264; (ii) a third cistron encoding CD55 wherein the nucleic acid sequence of CD55 is selected from the group consisting of SEQ ID NOS: 84, 85, 107, and 184; (iii) a promoter selected from SEQ ID NOS: 126-145, 167-168, 178-179, 231-238, and 250; (iv) a poly A sequence selected from SEQ ID NOS. 112-125 and, 154-156, 159-162, 190-192, and combinations thereof; (v) at least one 2A polypeptide having a sequence selected from SEQ ID NOS: 1-10, 12-14, and 159-162;

(c) an innate immunity cassette comprising: (i) a first cistron encoding a B2M HLA-E fusion protein wherein the nucleic acid sequence encoding the B2M HLA-E fusion protein is selected from the group consisting of SEQ ID NOS: 62, 66, 105; (ii) a second cistron encoding CD47 wherein the nucleic acid sequence of CD47 is selected from the group consisting of SEQ ID NOS: 77-83, 180, and 259; (iii) a promoter selected from SEQ ID NOS: 126-145, 167-168, 178-179, 231-238, and 250; (iv) a poly A sequence selected from SEQ ID NOS. 112-125 and, 154-156, 159-162, 190-192, and combinations thereof, (v) at least one 2A polypeptide having a sequence selected from SEQ ID NOS: 1-10, 12-14, and 159-162; and (d) an inflammation and apoptosis cassette comprising: (i) a first cistron encoding A20 wherein the nucleic acid sequence of A20 is selected from the group consisting of SEQ ID NOS: 64-65, 104, 182, and 188; (ii) a second cistron encoding PD-L1 wherein the nucleic acid sequence of PD-L1 is selected from the group consisting of SEQ ID NOS: 89-91; (iii) a promoter selected from SEQ ID NOS: 126-145, 167-168, 178-179, 231-238, and 250; (iv) a poly A sequence selected from SEQ ID NOS. 112-125 and, 154-156, 159-162, 190-192, and combinations thereof, and (v) at least one 2A polypeptide having a sequence selected from SEQ ID NOS: 1-10, 12-14, and 159-162.

In embodiments, the aforementioned nucleic acid comprises at least two of the aforementioned polycistronic cassettes. In embodiments, the aforementioned nucleic acid comprises at least three of the aforementioned polycistronic cassettes. In embodiments, the aforementioned nucleic acid comprises four of the aforementioned polycistronic cassettes. In embodiments, the nucleic acid comprises a sequence selected from the group consisting of SEQ ID NOS: 44, 172, 222, and 225.

Provided herein are nucleic acids comprising one or more polycistronic cassettes selected from the group consisting of:
  (a) a coagulation cassette comprising: (i) a first cistron encoding THBD wherein the nucleic acid sequence of THBD is selected from the group consisting of SEQ ID NOS: 97-102, 166, and 265-266; (ii) a second cistron encoding TFPI wherein the nucleic acid sequence of TFPI is selected from the group consisting of SEQ ID NOS: 94-96, 103, and 187; (iii) a promoter selected from SEQ ID NOS: 126-145, 167-168, 178-179, 231-238, and 250; (iv) a poly A sequence selected from SEQ ID NOS. 112-125 and, 154-156, 159-162, 190-192, and combinations thereof; (v) at least one 2A polypeptide having a sequence selected from SEQ ID NOS: 1-10, 12-14, and 159-162,
  (b) a complement regulation cassette comprising: (i) a first cistron encoding CD46 wherein the nucleic acid sequence of CD46 is selected from the group consisting of SEQ ID NOS: 71-76, 185, 200, 253-258, 262-264; (ii) a third cistron encoding CD55 wherein the nucleic acid sequence of CD55 is selected from the group consisting of SEQ ID NOS: 84, 85, 107, and 184; (iii) a promoter selected from SEQ ID NOS: 126-145, 167-168, 178-179, 231-238, and 250; (iv) a poly A sequence selected from SEQ ID NOS. 112-125 and, 154-156, 159-162, 190-192, and combinations thereof; (v) at least one 2A polypeptide having a sequence selected from SEQ ID NOS: 1-10, 12-14, and 159-162;
  (c) an innate immunity cassette comprising: (i) a first cistron encoding a B2M HLA-E fusion protein wherein the nucleic acid sequence encoding the B2M HLA-E fusion protein is selected from the group consisting of SEQ ID NOS: 62, 66, 105; (ii) a second cistron encoding CD47 wherein the nucleic acid sequence of CD47 is selected from the group consisting of SEQ ID NOS: 77-83, 180, and 259; (iii) a promoter selected from SEQ ID NOS: 126-145, 167-168, 178-179, 231-238, and 250; (iv) a poly A sequence selected from SEQ ID NOS. 112-125 and, 154-156, 159-162, 190-192, and combinations thereof, (v) at least one 2A polypeptide having a sequence selected from SEQ ID NOS: 1-10, 12-14, and 159-162, and
  (d) an apoptosis and coagulation cassette comprising: (i) a first cistron encoding XIAP wherein the nucleic acid sequence of XIAP is selected from the group consisting of SEQ ID NO: 110; (ii) a second cistron encoding CD39 wherein the nucleic acid sequence of CD39 is selected from the group consisting of SEQ ID NOS: 106; (iii) a promoter selected from SEQ ID NOS:

14

126-145, 167-168, 178-179, 231-238, and 250; and (iv) a poly A sequence selected from SEQ ID NOS. 112-125 and, 154-156, 159-162, 190-192, and combinations thereof, and (v) at least one 2A polypeptide having a sequence selected from SEQ ID NOS: 1-10, 12-14, and 159-162.

In embodiments, the aforementioned nucleic acid comprises at least two of the aforementioned polycistronic cassettes. In embodiments, the aforementioned nucleic acid comprises at least three of the aforementioned polycistronic cassettes. In embodiments, the aforementioned nucleic acid comprises four of the aforementioned polycistronic cassettes. In embodiments, the nucleic acid comprises a sequence of SEQ ID NO: 45 or SEQ ID NO: 223.

Provided herein are nucleic acids comprising one or more polycistronic cassettes selected from the group consisting of:
  (a) a coagulation cassette comprising: (i) a first cistron encoding THBD wherein the nucleic acid sequence of THBD is selected from the group consisting of SEQ ID NOS: 97-102, 166, and 265-266; (ii) a second cistron encoding TFPI wherein the nucleic acid sequence of TFPI is selected from the group consisting of SEQ ID NOS: 94-96, 103, and 187; (iii) a promoter selected from SEQ ID NOS: 126-145, 167-168, 178-179, 231-238, and 250; (iv) a poly A sequence selected from SEQ ID NOS. 112-125 and, 154-156, 159-162, 190-192, and combinations thereof, (v) at least one 2A polypeptide having a sequence selected from SEQ ID NOS: 1-10, 12-14, and 159-162;
  (b) a complement regulation cassette comprising: (i) a first cistron encoding CD46 wherein the nucleic acid sequence of CD46 is selected from the group consisting of SEQ ID NOS: 71-76, 185, 200, 253-258, 262-264; (ii) a third cistron encoding CD55 wherein the nucleic acid sequence of CD55 is selected from the group consisting of SEQ ID NOS: 84, 85, 107, and 184; (iii) a promoter selected from SEQ ID NOS: 126-145, 167-168, 178-179, 231-238, and 250; (iv) a poly A sequence selected from SEQ ID NOS. 112-125 and, 154-156, 159-162, 190-192, and combinations thereof; (v) at least one 2A polypeptide having a sequence selected from SEQ ID NOS: 1-10, 12-14, and 159-162;
  (c) an innate immunity cassette comprising: (i) a first cistron encoding a B2M HLA-E fusion protein wherein the nucleic acid sequence encoding the B2M HLA-E fusion protein is selected from the group consisting of SEQ ID NOS: 62, 66, 105; (ii) a second cistron encoding CD47 wherein the nucleic acid sequence of CD47 is selected from the group consisting of SEQ ID NOS: 77-83, 180, and 259; (iii) a promoter selected from SEQ ID NOS: 126-145, 167-168, 178-179, 231-238, and 250; (iv) a poly A sequence selected from SEQ ID NOS. 112-125 and, 154-156, 159-162, 190-192, and combinations thereof, (v) at least one 2A polypeptide having a sequence selected from SEQ ID NOS: 1-10, 12-14, and 159-162, and
  (d) an apoptosis and cell immunity cassette comprises: (i) a first cistron encoding A20 wherein the nucleic acid sequence of A20 is selected from the group consisting of SEQ ID NOS: 64-65, 104, 182, and 188; (ii) a second cistron encoding LEA29Y wherein the nucleic acid sequence of LEA29Y is selected from the group consisting of SEQ ID NOS: 87-88; (iii) a promoter selected from SEQ ID NOS: 126-145, 167-168, 178-179, 231-238, and 250; and (iv) a poly A sequence selected from SEQ ID NOS. 112-125 and, 154-156, 159-162, 190-192, and combinations thereof, and (v) at least one 2A polypeptide having a sequence selected from SEQ ID NOS: 1-10, 12-14, and 159-162.

In embodiments, the aforementioned nucleic acid comprises at least two of the aforementioned polycistronic cassettes. In embodiments, the aforementioned nucleic acid comprises at least three of the aforementioned polycistronic cassettes. In embodiments, the aforementioned nucleic acid comprises four of the aforementioned polycistronic cassettes. In embodiments, the nucleic acid comprises a sequence of SEQ ID NO: 46 or SEQ ID NO: 224.

In embodiments, provided herein is a nucleic acid comprising one or more polycistronic cassettes selected from the group consisting of:

(a) a coagulation and innate immunity cassette comprising: (i) a first cistron encoding a THBD protein wherein the nucleic acid sequence of THBD is selected from the group consisting of SEQ ID NOS: 97-102, 166, and 265-266; (ii) a second cistron encoding a CD47 protein wherein the nucleic acid sequence of CD47 is selected from the group consisting of SEQ ID NOS: 77-83 and 180; (iii) a third cistron encoding an EPCR protein wherein the nucleic acid sequence of EPCR is selected from the group consisting of SEQ ID NOS: 94-96, 103, and 187; (iv) a promoter selected from SEQ ID NOS: 126-145, 167-168, 178-179, 231-238, and 250; (v) a poly A sequence selected from SEQ ID NOS. 112-125, 154-156, 159-162, 190-192, and 239-240, and combinations thereof; and (vi) at least one 2A polypeptide encoded by a sequence selected from SEQ ID NOS: 1-10, 12-14, and 159-162;

(b) an apoptosis and cell immunity cassette comprises: (i) a first cistron encoding an A20 protein wherein the nucleic acid sequence of A20 is selected from the group consisting of SEQ ID NOS: 64-65, 104, 182, and 188; (ii) a second cistron encoding a HO1 protein wherein the nucleic acid sequence of HO1 is selected from the group consisting of SEQ ID NOS: 63, 109, 165, 183, and 189; (iii) a promoter selected from SEQ ID NOS: 126-145, 167-168, 178-179, 231-238, and 250; (iv) a poly A sequence selected from SEQ ID NOS. 112-125, 154-156, 159-162, 190-192, and 239-240, and combinations thereof, and (v) at least one 2A polypeptide encoded by a sequence selected from SEQ ID NOS: 1-10, 12-14, and 159-162; and (c) a complement regulation cassette comprising: (i) a first cistron encoding a CD46 protein wherein the nucleic acid sequence of CD46 is selected from the group consisting of SEQ ID NOS: 71-76, 185, 200, 253-258, 262-264; (ii) a third cistron encoding a CD55 protein wherein the nucleic acid sequence of CD55 is selected from the group consisting of SEQ ID NOS: 84, 85, 107, and 184; (iii) a promoter selected from SEQ ID NOS: 126-145, 167-168, 178-179, 231-238, and 250; (iv) a poly A sequence selected from SEQ ID NOS. 112-125, 154-156, 159-162, 190-192, and 239-240, and combinations thereof; and (v) at least one 2A polypeptide encoded by a sequence selected from SEQ ID NOS: 1-10, 12-14, and 159-162.

In embodiments, the aforementioned nucleic acid comprises at least two of the aforementioned polycistronic cassettes. In embodiments, the aforementioned nucleic acid comprises at least three of the aforementioned polycistronic cassettes. In embodiments, the aforementioned nucleic acid comprises four of the aforementioned polycistronic cassettes. In embodiments, the nucleic acid comprises a sequence of SEQ ID NO: 174 or SEQ ID NO: 227.

In embodiments, provided herein is a nucleic acid comprising one or more polycistronic cassettes selected from the group consisting of:

(a) a coagulation and innate immunity cassette comprising: (i) a first cistron encoding a THBD protein wherein the nucleic acid sequence of THBD is selected from the group consisting of SEQ ID NOS: 97-102, 166, and 265-266; (ii) a second cistron encoding a CD47 protein wherein the nucleic acid sequence of CD47 is selected from the group consisting of SEQ ID NOS: 77-83 and 180; (iii) a third cistron encoding an EPCR protein wherein the nucleic acid sequence of EPCR is selected from the group consisting of SEQ ID NOS: 94-96, 103, and 187; (iv) a promoter selected from SEQ ID NOS: 126-145, 167-168, 178-179, 231-238, and 250; (v) a poly A sequence selected from SEQ ID NOS. 112-125, 154-156, 159-162, 190-192, and 239-240, and combinations thereof; and (vi) at least one 2A polypeptide encoded by a sequence selected from SEQ ID NOS: 1-10, 12-14, and 159-162;

(b) an apoptosis and cell immunity cassette comprising: (i) a first cistron encoding an A20 protein wherein the nucleic acid sequence of A20 is selected from the group consisting of SEQ ID NOS: 64-65, 104, 182, and 188; (ii) a second cistron encoding a CTLA-4 protein wherein the nucleic acid sequence of CTLA-4 is selected from the group consisting of SEQ ID NOS: 87-88, 174, and 186; (iii) a promoter selected from SEQ ID NOS: 126-145, 167-168, 178-179, 231-238, and 250; (iv) a poly A sequence selected from SEQ ID NOS. 112-125, 154-156, 159-162, 190-192, and 239-240, and combinations thereof; and (v) at least one 2A polypeptide encoded by a sequence selected from SEQ ID NOS: 1-10, 12-14, and 159-162; and (c) a complement regulation cassette comprising: (i) a first cistron encoding a CD46 protein wherein the nucleic acid sequence of CD46 is selected from the group consisting of SEQ ID NOS: 71-76, 185, 200, 253-258, 262-264; (ii) a third cistron encoding a CD55 protein wherein the nucleic acid sequence of CD55 is selected from the group consisting of SEQ ID NOS: 84, 85, 107, and 184; (iii) a promoter selected from SEQ ID NOS: 126-145, 167-168, 178-179, 231-238, and 250; (iv) a poly A sequence selected from SEQ ID NOS. 112-125, 154-156, 159-162, 190-192, and 239-240, and combinations thereof; (v) at least one 2A polypeptide encoded by a sequence selected from SEQ ID NOS: 1-10, 12-14, and 159-162.

In embodiments, the aforementioned nucleic acid comprises at least two of the aforementioned polycistronic cassettes. In embodiments, the aforementioned nucleic acid comprises at least three of the aforementioned polycistronic cassettes. In embodiments, the aforementioned nucleic acid comprises four of the aforementioned polycistronic cassettes. In embodiments, the nucleic acid comprises a sequence of SEQ ID NO: 175 or SEQ ID NO: 228.

In embodiments, provided herein is a nucleic acid comprising one or more polycistronic cassettes selected from the group consisting of:

(a) a coagulation cassette comprising: (i) a first cistron encoding a THBD protein wherein the nucleic acid sequence encoding the THBD protein is selected from the group consisting of SEQ ID NOS: 97-102, 166, and 265-266; (ii) a second cistron encoding a TFPI protein wherein the nucleic acid sequence of encoding the TFPI protein is selected from the group consisting of SEQ ID NOS: 94-96, 103, and 187; (iii) a promoter selected from SEQ ID NOS: 126-145, 167-168, 178-179, 231-238, and 250; (iv) a poly A sequence selected from SEQ ID NOS. 112-125, 154-156, 159-162, 190-192, and 239-240, and combinations thereof; and (v) at least one 2A polypeptide encoded by a sequence selected from SEQ ID NOS: 1-10, 12-14, and 159-162;

(b) an innate immunity cassette comprising: (i) a first cistron encoding a B2M HLA-E fusion protein wherein the nucleic acid sequence encoding the B2M HLA-E fusion protein is selected from the group consisting of SEQ ID NOS: 62, 66, 105; (ii) a second cistron encoding a CD47 protein wherein the nucleic acid sequence encoding the CD47 protein is selected from the group consisting of SEQ ID NOS: 77-83, 180, and 259; (iii) a promoter selected from SEQ ID NOS: 126-145, 167-168, 178-179, 231-238, and 250; (iv) a poly A sequence selected from SEQ ID NOS. 112-125, 154-156, 159-162, 190-192, and 239-240, and combinations thereof; and (v) at least one 2A polypeptide encoded by a sequence selected from SEQ ID NOS: 1-10, 12-14, and 159-162.

(c) a complement regulation cassette comprising: (i) a first cistron encoding a CD46 protein wherein the nucleic acid sequence encoding the CD46 protein is selected from the group consisting of SEQ ID NOS: 71-76, 185, 200, 253-258, 262-264; (ii) a second cistron encoding a CD55 protein wherein the nucleic acid sequence encoding the CD55 protein is selected from the group consisting of SEQ ID NOS: 84, 85, 107, and 184; (iii) a promoter selected from SEQ ID NOS: 126-145, 167-168, 178-179, 231-238, and 250; (iv) a poly A sequence selected from SEQ ID NOS. 112-125, 154-156, 159-162, 190-192, and 239-240, and combinations thereof; and (v) at least one 2A polypeptide encoded by a sequence selected from SEQ ID NOS: 1-10, 12-14, and 159-162.

In embodiments, the aforementioned nucleic acid comprises at least two of the aforementioned polycistronic cassettes. In embodiments, the aforementioned nucleic acid comprises at least three of the aforementioned polycistronic cassettes. In embodiments, the aforementioned nucleic acid comprises four of the aforementioned polycistronic cassettes. In embodiments, the nucleic acid comprises a sequence of SEQ ID NO: 176 or SEQ ID NO: 229.

In embodiments, provided herein is a nucleic acid comprising one or more polycistronic cassettes selected from the group consisting of:

(a) a coagulation cassette comprising: (i) a first cistron encoding a THBD protein wherein the nucleic acid sequence encoding the THBD protein is selected from the group consisting of SEQ ID NOS: 97-102, 166, and 265-266; (ii) a second cistron encoding a TFPI protein wherein the nucleic acid sequence of encoding the TFPI protein is selected from the group consisting of SEQ ID NOS: 94-96, 103, and 187; (iii) a promoter selected from SEQ ID NOS: 126-145, 167-168, 178-179, 231-238, and 250; (iv) a poly A sequence selected from SEQ ID NOS. 112-125, 154-156, 159-162, 190-192, and 239-240, and combinations thereof; and (v) at least one 2A polypeptide encoded by a sequence selected from SEQ ID NOS: 1-10, 12-14, and 159-162;

(b) an innate immunity cassette comprising: (i) a first cistron encoding a B2M HLA-E fusion protein wherein the nucleic acid sequence encoding the B2M HLA-E fusion protein is selected from the group consisting of SEQ ID NOS: 62, 66, 105; (ii) a second cistron encoding a CD47 protein wherein the nucleic acid sequence encoding the CD47 protein is selected from the group consisting of SEQ ID NOS: 77-83, 180, and 259; (iii) a promoter selected from SEQ ID NOS: 126-145, 167-168, 178-179, 231-238, and 250; (iv) a poly A sequence selected from SEQ ID NOS. 112-125, 154-156, 159-162, 190-192, and 239-240, and combinations thereof; and (v) at least one 2A polypeptide encoded by a sequence selected from SEQ ID NOS: 1-10, 12-14, and 159-162.

(c) a complement regulation cassette comprising: (i) a first cistron encoding a CD46 protein wherein the nucleic acid sequence encoding the CD46 protein is selected from the group consisting of SEQ ID NOS: 71-76, 185, 200, 253-258, 262-264; (ii) a second cistron encoding a CD55 protein wherein the nucleic acid sequence encoding the CD55 protein is selected from the group consisting of SEQ ID NOS: 84, 85, 107, and 184; (iii) a promoter selected from SEQ ID NOS: 126-145, 167-168, 178-179, 231-238, and 250; (iv) a poly A sequence selected from SEQ ID NOS. 112-125, 154-156, 159-162, 190-192, and 239-240, and combinations thereof; and (v) at least one 2A polypeptide encoded by a sequence selected from SEQ ID NOS: 1-10, 12-14, and 159-162; and (d) an inflammation and apoptosis cassette comprising: (i) a first cistron encoding an A20 protein wherein the nucleic acid sequence of A20 is selected from the group consisting of SEQ ID NOS: 64-65, 104, 182, and 188; (ii) a second cistron encoding a HO1 protein wherein the nucleic acid sequence of HO1 is selected from the group consisting of SEQ ID NOS: 63, 109, 165, 183, and 189; (iii) a promoter selected from SEQ ID NOS: 126-145, 167-168, 178-179, 231-238, and 250; (iv) a poly A sequence selected from SEQ ID NOS. 112-125, 154-156, 159-162, 190-192, and 239-240, and combinations thereof; and (v) at least one 2A polypeptide encoded by a sequence selected from SEQ ID NOS: 1-10, 12-14, and 159-162.

In embodiments, the aforementioned nucleic acid comprises at least two of the aforementioned polycistronic cassettes. In embodiments, the aforementioned nucleic acid comprises at least three of the aforementioned polycistronic cassettes. In embodiments, the aforementioned nucleic acid comprises four of the aforementioned polycistronic cassettes. In embodiments, the nucleic acid comprises a sequence of SEQ ID NO: 177 or SEQ ID NO: 230.

Provided herein is a nucleic acid comprising a CD46 cistron, comprising or consisting of a nucleic acid sequence selected from the group consisting of SEQ ID NOS: 72, 73, 185, and 200. Provided herein is a nucleic acid comprising a THBD cistron comprising or consisting of a nucleic acid sequence selected from any one of SEQ ID NOS: 99-102 and 166. In embodiments, provided herein is a cell comprising a nucleic acid comprising a CD46 cistron comprising or consisting of a nucleic acid sequence selected from the group consisting of SEQ ID NOS: 72, 73, 185, and 200. In embodiments, provided herein is a cell comprising a nucleic acid comprising a THBD cistron, comprising or consisting of a nucleic acid sequence selected from any one of SEQ ID NOS: 99-102 and 166. In embodiments, provided herein is a tissue, organ, or animal comprising a cell comprising a nucleic acid comprising a CD46 cistron comprising or consisting of a nucleic acid sequence selected from the group consisting of SEQ ID NOS: 72, 73, 185, and 200. In embodiments, provided herein is a tissue, organ, or animal comprising a cell comprising a nucleic acid comprising a THBD cistron comprising or consisting of a nucleic acid sequence selected from any one of SEQ ID NOS: 99-102 and 166.

In embodiments, a nucleic acid described herein comprises a 5' loxP site and a 3' loxP site selected from the group consisting of SEQ ID NOS: 146-150 and 244. In embodiments, a nucleic acid described herein comprises a 5' insulator site and a 3' insulator site selected from the group consisting of SEQ ID NOS: 49-58 and 163-164. In embodiments, a nucleic acid described herein comprises a 5' guide RNA (gRNA) target sequence and a 3' gRNA target sequence having a sequence selected from SEQ ID NOS: 47-48, and combinations thereof. In embodiments, a nucleic acid described herein comprises an ubiquitous chromatin opening element (UCOE) having a sequence of any one of SEQ ID NOS: 19-22, 157, and 193. In embodiments, a nucleic acid described herein comprises: (i) a first inverted terminal repeat (ITR) located 5' to the 5' polycistronic cassette and having a sequence of SEQ ID NO: 17 or 18, and (ii) a second ITR located 3' to the 3' polycistronic cassettes and having a sequence of SEQ ID NO: 15 or 16. In embodiments, a nucleic acid described herein comprises at least two polycistronic cassettes. In embodiments, a nucleic acid described herein comprises at least three polycistronic cassettes. In embodiments, a nucleic acid described herein comprises at least four polycistronic cassettes. In embodiments, a nucleic acid described herein comprises a fluorescent protein. In embodiments, a nucleic acid described herein comprises a green fluorescent protein having a sequence of SEQ ID NO: 111, 242, or 246.

In embodiments, provided herein is a vector comprising any of the aforementioned nucleic acids. In embodiments, provided herein is a cell comprising any of the aforementioned nucleic acids. In embodiments, provided herein is an islet cell comprising any of the aforementioned nucleic acids. In embodiments, provided herein is a porcine cell comprising any of the aforementioned nucleic acids. In embodiments, provided herein is an organ or tissue comprising any of the aforementioned nucleic acids. In embodiments, provided herein is an animal comprising any of the aforementioned nucleic acids. In embodiments, provided herein is a porcine comprising any of the aforementioned nucleic acids. In embodiments, provided herein is a porcine comprising any of the aforementioned nucleic acids, wherein the porcine is PERV free. In embodiments, provided herein is an animal comprising any of the aforementioned nucleic acids, wherein the animal comprises at least one inactivated carbohydrate antigen producing gene. In embodiments, provided herein is an animal comprising any of the aforementioned nucleic acids, wherein the animal comprises at least one inactivated carbohydrate antigen producing gene, and wherein the inactivated carbohydrate antigen producing gene is glycoprotein alpha-1,3-galactosyltransferase (GGTA1), cytidine monophosphate-N-acetylneuraminic acid hydrolase (CMAH), β-1,4-N-Acetyl-Galactosaminyltransferase 2 (β4GALNT2), or a combination thereof.

In embodiments, provided herein is a contiguous nucleic acid sequence of any of SEQ ID NOS: 23 to 46, 172-177, and 201-230. In embodiments, the contiguous nucleic acid sequence is at least about 1 kb. In embodiments, the contiguous nucleic acid sequence is at least 2 kb, at least 3 kb, at least 4 kb, at least 5 kb, at least 6 kb, at least 7 kb, at least 8 kb, at least 9 kb, at least 10 kb, at least 11 kb, at least 12 kb, at least 13 kb, at least 14 kb, at least 15 kb, at least 16 kb, at least 17 kb, at least 18 kb, at least 19 kb, at least 20 kb, at least 21 kb, at least 22 kb, at least 23 kb, at least 24 kb, at least 25 kb, at least 26 kb, at least 27 kb, at least 28 kb, at least 29 kb, at least 30 kb, at least 35 kb, at least 40 kb, at least 45 kb, at least 50 kb, at least 55 kb, at least 60 kb, or at least 65 kb in length. In embodiments, the contiguous nucleic acid sequence encodes one or more of the aforementioned polycistronic cassettes. In embodiments, the contiguous nucleic acid sequence encodes at least two of the aforementioned polycistronic cassettes. In embodiments, the contiguous nucleic acid sequence encodes at least three of the aforementioned polycistronic cassettes. In embodiments, the contiguous nucleic acid sequence encodes at least four of the aforementioned polycistronic cassettes.

In embodiments, provided herein is a chromosomally integrated form of any of SEQ ID NOS: 23-46, 172-177, and 201-230.

In embodiments, provided herein is a contiguous nucleic acid sequence that is 80%, 81%, 82%, 83%, 84%, 85%, 86%, 87%, 88%, 89%, 90%, 91%, 92%, 93%, 94%, 95%, 96%, 97%, 98%, 99% identical to any of SEQ ID NOS: 23-46, 172-177, and 201-230. In embodiments, provided herein is a contiguous nucleic acid sequence that is 95% identical to any of SEQ ID NOS: 23-46, 172-177, and 201-230. In embodiments, provided herein is a contiguous nucleic acid sequence that is at least 96% identical to any of SEQ ID NOS: 23-46, 172-177, and 201-230. In embodiments, provided herein is a contiguous nucleic acid sequence that is at least 97% identical to any of SEQ ID NOS: 23-46, 172-177, and 201-230. In embodiments, provided herein is a contiguous nucleic acid sequence that is at least 98% identical to any of SEQ ID NOS: 23-46, 172-177, and 201-230. In embodiments, provided herein is a contiguous nucleic acid sequence that is at least 99% identical to any of SEQ ID NOS: 23-46, 172-177, and 201-230. In embodiments, provided herein is a contiguous nucleic acid sequence that is at least 95% identical to any of SEQ ID NOS: 23-46, 172-177, and 201-230, wherein the sequence encodes at least two polycistronic cassettes. In embodiments, provided herein is a contiguous nucleic acid sequence that is at least 95% identical to any of SEQ ID NOS: 23-46, 172-177, and 201-230, wherein the sequence encodes at least three polycistronic cassettes. In embodiments, provided herein is a contiguous nucleic acid sequence that is at least 95% identical to any of SEQ ID NOS: 23-46, 172-177, and 201-230, wherein the sequence encodes at least four polycistronic cassettes. In embodiments, provided herein is a contiguous nucleic acid sequence that is at least 96%, at least 97% at least 98%, at least 99%, or at least 99.5% identical to any one of SEQ ID NOS: 23 to 46, 172-177, and 201-230.

In embodiments, provided herein is a contiguous nucleic acid sequence encoding a polycistronic gene product polypeptide that is expressed by any of the polycistronic cassettes. In embodiments, provided herein is a polypeptide comprising one or more of the proteins encoded by a cistron of any of the polycistronic cassettes described herein.

In embodiments, provided herein is a nucleic acid sequence that is at least 95%, at least 96%, at least 97%, at least 98%, at least 99%, or 100% identical to the non-coding sequence of any one of SEQ ID NOS: 23 to 46, 172-177, and 201-230 and at least 80%, at least 85%, at least 90%, at least 91%, at least 92%, at least 93%, at least 94%, at least 95%, at least 96%, at least 97%, at least 98%, at least 99%, or 100% identical to the coding sequence of any one of SEQ ID NOS: 23 to 46, 172-177, and 201-230.

In embodiments, provided herein is a method of genetically modifying a cell comprising: (i) knocking out porcine endogenous retrovirus (PERV) elements; (ii) knocking out glycoprotein α-1,3-galactosyltransferase gene (GGTA1), cytidine monophosphate-N-acetylneuraminic acid hydroxylase (CMAH), β-1,4-N-acetylgalactosaminyltransferase 2 (β4GALNT2), or any combination thereof; and (iii) knocking in any one or more polycistronic cassettes of any one of claims 1-14. In embodiments, step (i) is performed first, step (ii) is performed second, and step (iii) is performed third. In embodiments, step (i) is performed first, step (ii) is performed third, and step (iii) is performed second. In embodiments, step (i) is performed second, step (ii) is performed first, and step (iii) is performed third. In embodiments, step (i) is performed second, step (ii) is performed third, and step (iii) is performed first. In embodiments, step (i) is performed third, step (ii) is performed first, and step (iii) is performed second. In embodiments, step (i) is performed third, step (ii) is performed second, and step (iii) is performed first. In embodiments, provided herein is a genetically modified cell produced by any of the aforementioned methods. In embodiments, provided herein is an animal, organ, or tissue comprising the genetically modified cell. In embodiments, the animal is porcine or a human.

In embodiments, provided herein is a landing pad, wherein the landing pad is a nucleic acid comprising a first loxP site, a second loxP site, a promoter, and a poly A sequence. In embodiments, the landing pad comprises an insulator sequence. In embodiments, the landing pad comprises a fluorescent protein. In embodiments, the landing pad comprises a nucleic acid of SEQ ID NO: 248 or 249. In embodiments, provided herein is a genetically modified cell comprising the landing pad. In embodiments, provided herein are tissues, organs, or animals comprising genetically modified cells comprising landing pads.

In embodiments, provided herein is a nucleic acid comprising a first loxP site, a second loxP site, and one or more of the polycistronic cassettes described herein. In embodiments, provided herein are genetically modified cells comprising the aforementioned nucleic acid. In embodiments, provided herein are tissues, organs, or animals comprising the aforementioned genetically modified cells. In embodiments, the nucleic acids comprise a sequence of any one of SEQ ID NOS: 201-230 or a nucleic acid that is at least 80%, at least 85%, at least 90%, at least 91%, at least 92%, at least 93%, at least 94%, at least 95%, at least 96%, at least 97%, at least 98%, at least 99%, or 100% identical to any one of SEQ ID NOS: 201-230. In embodiments, provided herein is a genetically modified cell comprising a nucleic acid of any one of SEQ ID NOS: 201-230 or a nucleic acid that is at least 80%, at least 85%, at least 90%, at least 91%, at least 92%, at least 93%, at least 94%, at least 95%, at least 96%, at least 97%, at least 98%, at least 99%, or 100% identical to any one of SEQ ID NOS: 201-230. In embodiments, provided herein is a tissue, organ, or animal comprising the genetically modified cell comprising a nucleic acid of any one of SEQ ID NOS: 201-230 or a nucleic acid that is at least 80%, at least 85%, at least 90%, at least 91%, at least 92%, at least 93%, at least 94%, at least 95%, at least 96%, at least 97%, at least 98%, at least 99%, or 100% identical to any one of SEQ ID NOS: 201-230.

Figure 1A:
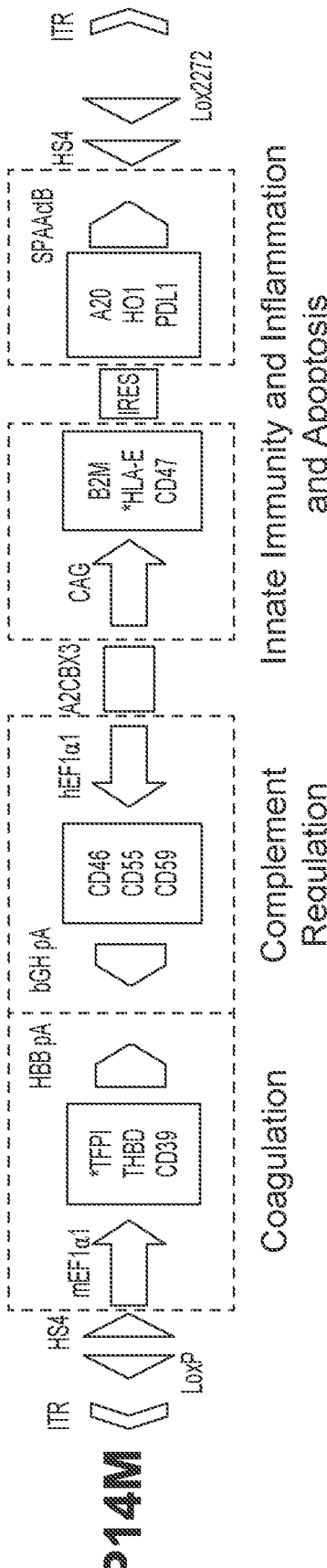
FIG. 1A illustrates an exemplary nucleic acid comprising a coagulation cassette under the control of a mmEF1α1 (denoted mEF1α1) promoter comprising cistrons for TFPI, THBD, and CD39, a complement regulation cassette, under the control of a hEF1α1 promoter, comprising cistrons for CD46, CD55, and CD59, and an innate immunity.

22 inflammation and apoptosis cassette, under the control of a CAG promoter, comprising cistrons for a B2M HLA-E fusion protein, CD47, A20, HO1, and PD-L1. Genes within each cassette are separated by nucleic acid sequences encoding 2A peptides (E2A, T2A, F2A, P2A) or an Internal Ribosomal Entry Site (IRES). Each cassette also contains a poly A sequence (e.g., HBB, bGH, or SPAActB). An exemplary nucleic acid having the cassettes of FIG. 1A is SEQ ID NO. 23.

Figure 1B:
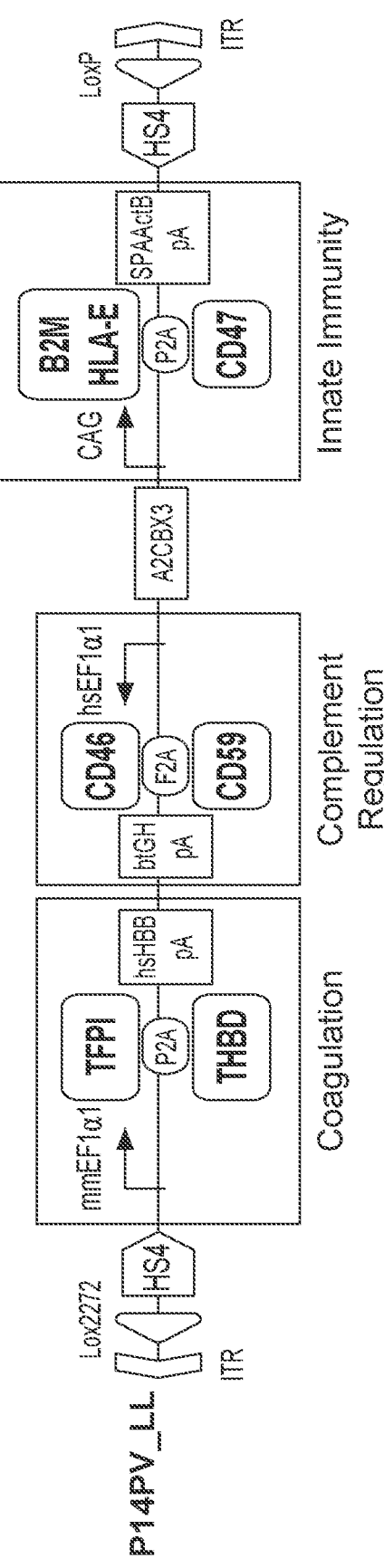

FIG. 1B illustrates an exemplary nucleic acid comprising a coagulation cassette under the control of a mmEF1α1 promoter comprising TFPI and THBD, a complement regulation cassette under the control of a hEF1α1 (denoted hsEF1α1) promoter comprising CD46_LL (denoted as CD46) and CD59 cistrons, and an innate immunity cassette under the control of a CAG promoter comprising a nucleic acid encoding a B2M HLA-E fusion protein and a CD47 cistron. Genes within each cassette are separated by nucleic acids encoding 2A peptides (P2A or F2A) or IRES. Each cassette also contains a poly A sequence (e.g., HBB, btGH, or SPAActB). An exemplary nucleic acid having the cassettes of FIG. 1B is SEQ ID NO. 25.

Figure 1C:
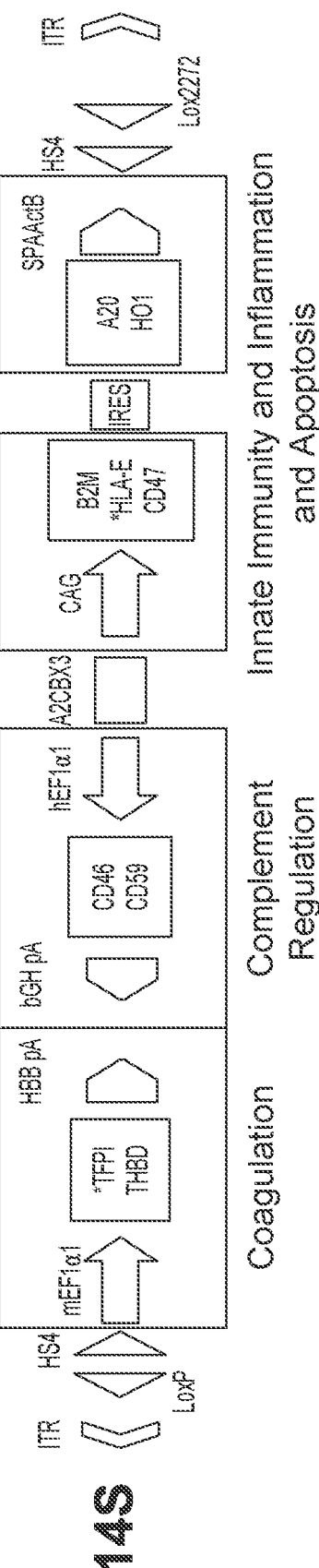

FIG. 1C illustrates an exemplary nucleic acid comprising a coagulation cassette under the control of a mmEF1α1 (denoted mEF1α1) promoter comprising TFPI and THBD cistrons, a complement regulation cassette under the control of a hEF1α1 promoter comprising CD46 and CD59 cistrons, and an innate immunity and inflammation and apoptosis cassette under the control of a CAG promoter comprising a nucleic acid encoding a B2M HLA-E fusion protein and CD47, A20, and HO1 cistrons. Genes within each cassette are separated by nucleic acids encoding 2A peptides (E2A, T2A, F2A, P2A) or IRES. Each cassette also contains a poly A sequence (e.g., HBB, bGH, or SPAActB). An exemplary nucleic acid having the cassettes of FIG. 1C is SEQ ID NO. 26.

Figure 1D:
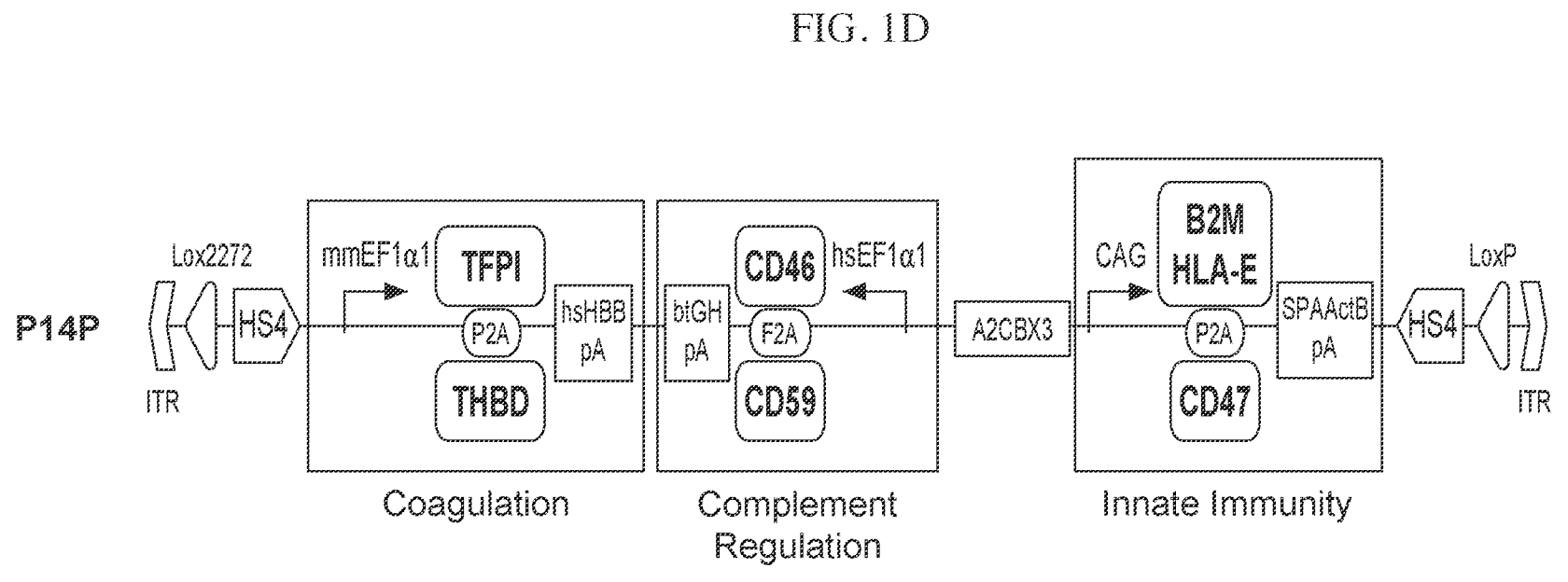

FIG. 1D illustrates an exemplary nucleic acid comprising a coagulation cassette under the control of a mmEF1α1 promoter comprising TFPI and THBD cistrons, a complement regulation cassette under the control of a hEF1α1 (denoted hsEF1α1) promoter comprising CD46 and CD59 cistrons, and an innate immunity cassette under the control of a CAG promoter comprising a nucleic acid encoding a B2M HLA-E fusion protein and a CD47 cistron. Genes within each cassette are separated by nucleic acids encoding 2A peptides (E2A, T2A, F2A, P2A) or IRES. Each cassette also contains a poly A sequence (e.g., HBB, btGH, or SPAActB). An exemplary nucleic acid having the cassettes of FIG. 1D is SEQ ID NO. 24.

Figure 2A:
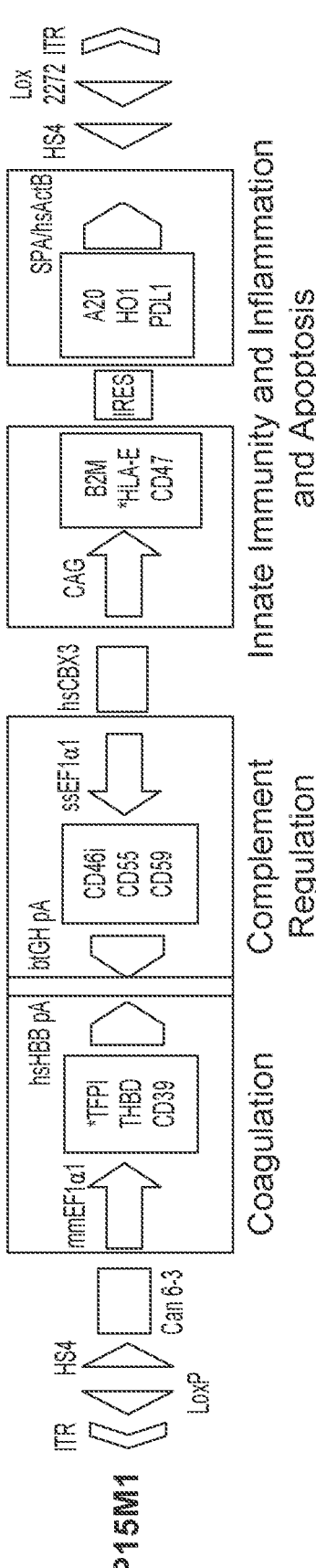

FIG. 2A illustrates an exemplary nucleic acid comprising a coagulation cassette under the control of a mmEF1α1 promoter comprising TFPI, THBD, and CD39 cistrons, a complement regulation cassette under the control of a ssEF1α1 promoter comprising CD46i, CD59, and CD55 cistrons, and an innate immunity and inflammation and apoptosis cassette under the control of a CAG promoter comprising a nucleic acid encoding a B2M HLA-E fusion protein and CD47, A20, HO1, and PD-L1 cistrons. Genes within each cassette are separated by nucleic acids encoding 2A peptides (E2A, T2A, F2A, P2A) or IRES. Each cassette also contains a poly A sequence (e.g., HBB, btGH, or SPA/hsActB). An exemplary nucleic acid having the cassettes of FIG. 2A is SEQ ID NO. 27.

Figure 2B:
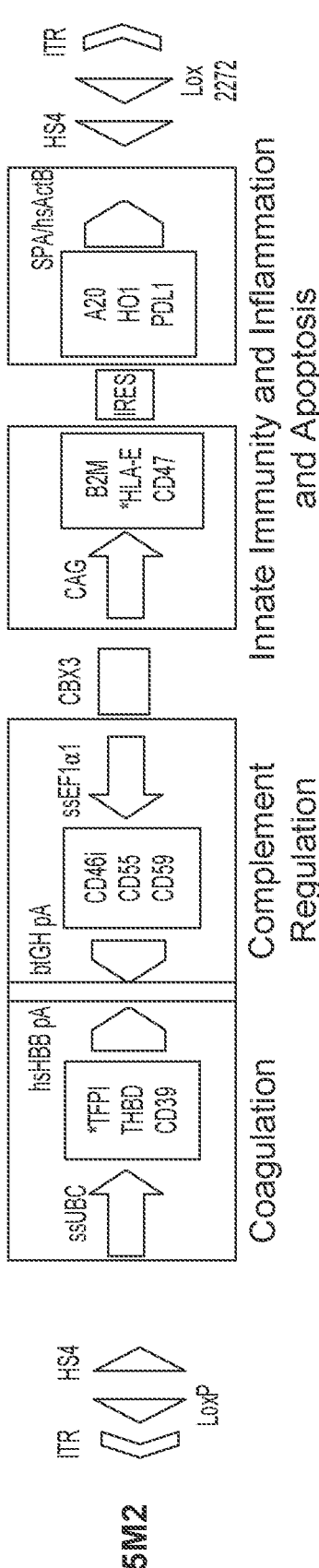

FIG. 2B illustrates an exemplary nucleic acid comprising a coagulation cassette under the control of a ssUBC promoter comprising TFPI, THBD, and CD39, a complement regulation cassette under the control of a ssEF1α1 promoter comprising CD46i, CD59, and CD55 cistrons, and an innate immunity and inflammation and apoptosis cassette under the control of a CAG promoter comprising a nucleic acids encoding a B2M HLA-E fusion protein and CD47, A20, HO1, and PD-L1 cistrons. Genes within each cassette are separated by nucleic acids encoding 2A peptides (E2A, T2A, F2A, P2A). Each cassette also contains a poly A sequence (e.g., HBB, btGH, or SPA/hsActB). An exemplary nucleic acid having the cassettes of FIG. 2B is SEQ ID NO. 28.

Figure 2C:
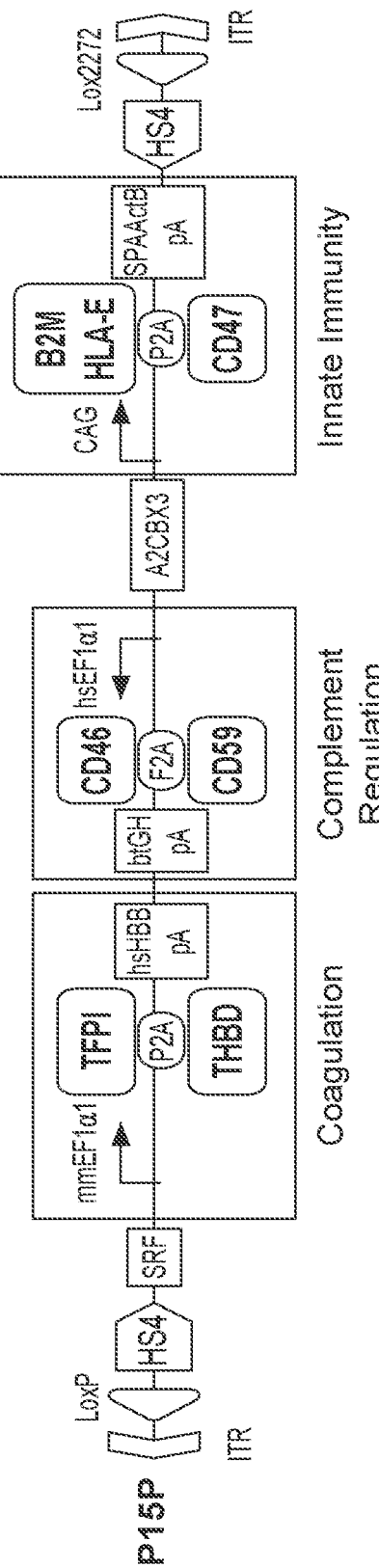

FIG. 2C illustrates an exemplary nucleic acid comprising a coagulation cassette under the control of a mmEF1α1 promoter comprising TFPI and THBD, a complement regulation cassette under the control of a hEF1α1 (denoted hsEF1α1) promoter comprising CD46_LL (denoted as CD46) and CD59, and an innate immunity cassette under the control of a CAG promoter comprising a B2M HLA-E fusion protein and CD47. Genes within each cassette are separated by nucleic acids encoding 2A peptides (E2A, T2A, F2A, P2A). Each cassette also contains a poly A sequence (e.g., hsHBB, btGH, or SPAActB). An exemplary nucleic acid having the cassettes of FIG. 2C is SEQ ID NO. 29.

Figure 2D:
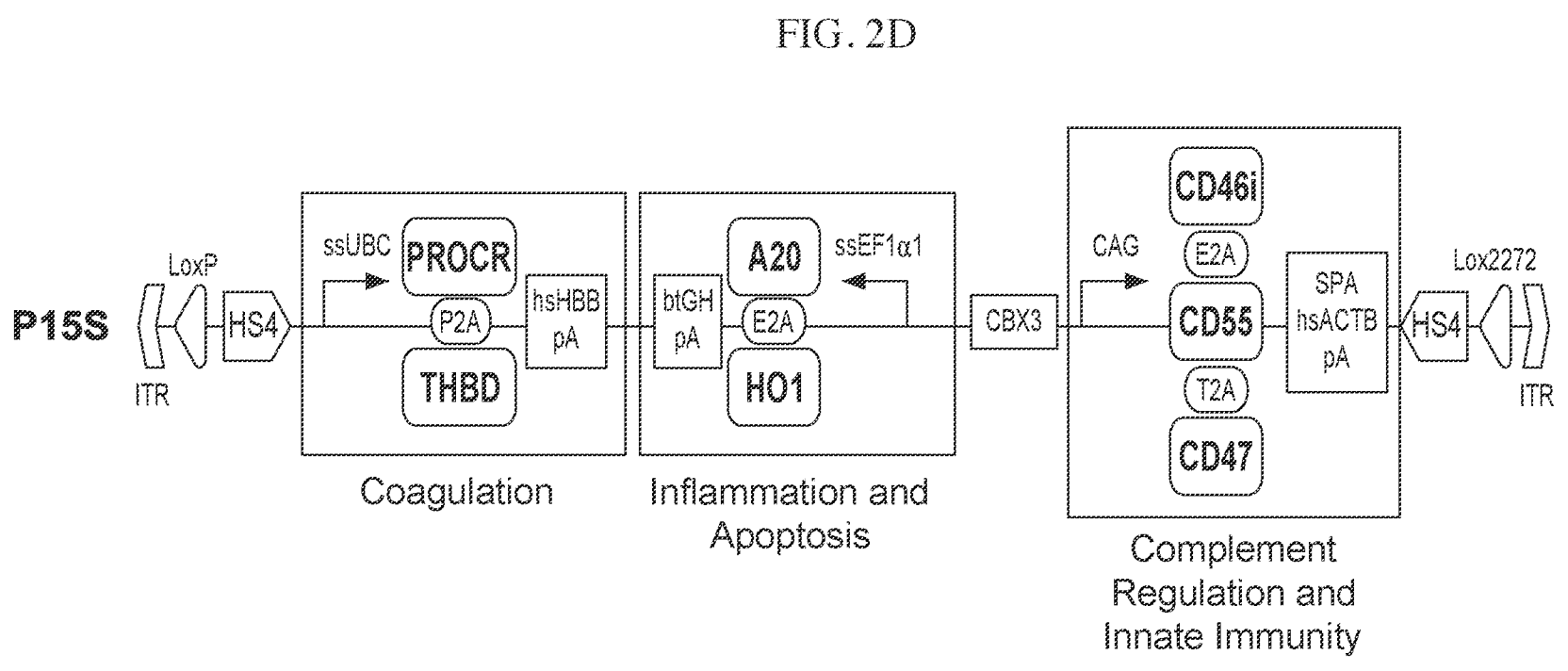

FIG. 2D illustrates an exemplary nucleic acid comprising a coagulation cassette under the control of a ssUBC promoter comprising PROCR and THBD, an inflammation and apoptosis cassette under the control of a ssEF1α1 promoter comprising A20 and HO1, and a complement regulation and innate immunity cassette under the control of a CAG promoter comprising CD46i, CD55, and CD47. Genes within each cassette are separated by nucleic acids encoding 2A peptides (E2A, T2A, F2A, P2A). Each cassette also contains a poly A sequence (e.g., hsHBB, btGH, or SPA hsActB). An exemplary nucleic acid having the cassettes of FIG. 2D is SEQ ID NO. 30.

Figure 2E:
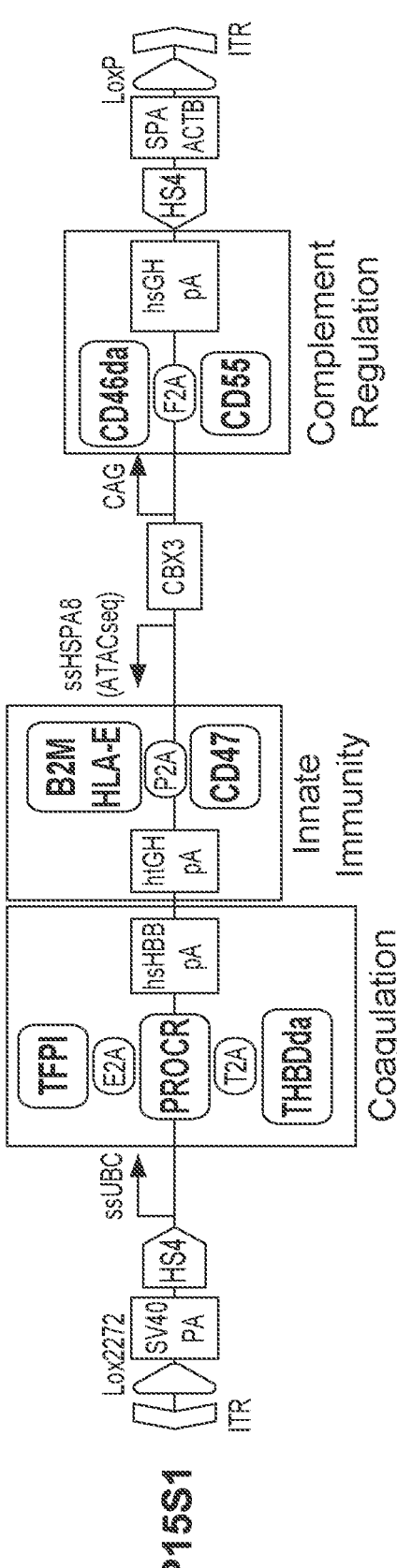

FIG. 2E illustrates an exemplary nucleic acid comprising a coagulation cassette under the control of a ssUBC promoter comprising TFPI, PROCR, and THBD (denoted THBDda), an innate immunity cassette under the control of a ssHSPA8 (denoted ssHSPA8 (ATACseq)) promoter comprising a B2M HLA-E fusion protein and CD47, and a complement regulation cassette under the control of a CAG promoter comprising CD46da1 (denoted as CD46da) and CD55. Genes within each cassette are separated by nucleic acids encoding 2A peptides (E2A, T2A, F2A, P2A). Each cassette also contains a poly A sequence (e.g., hsHBB, btGH, or hsGH). An exemplary nucleic acid having the cassettes of FIG. 2E is SEQ ID NO. 31.

Figure 2F:
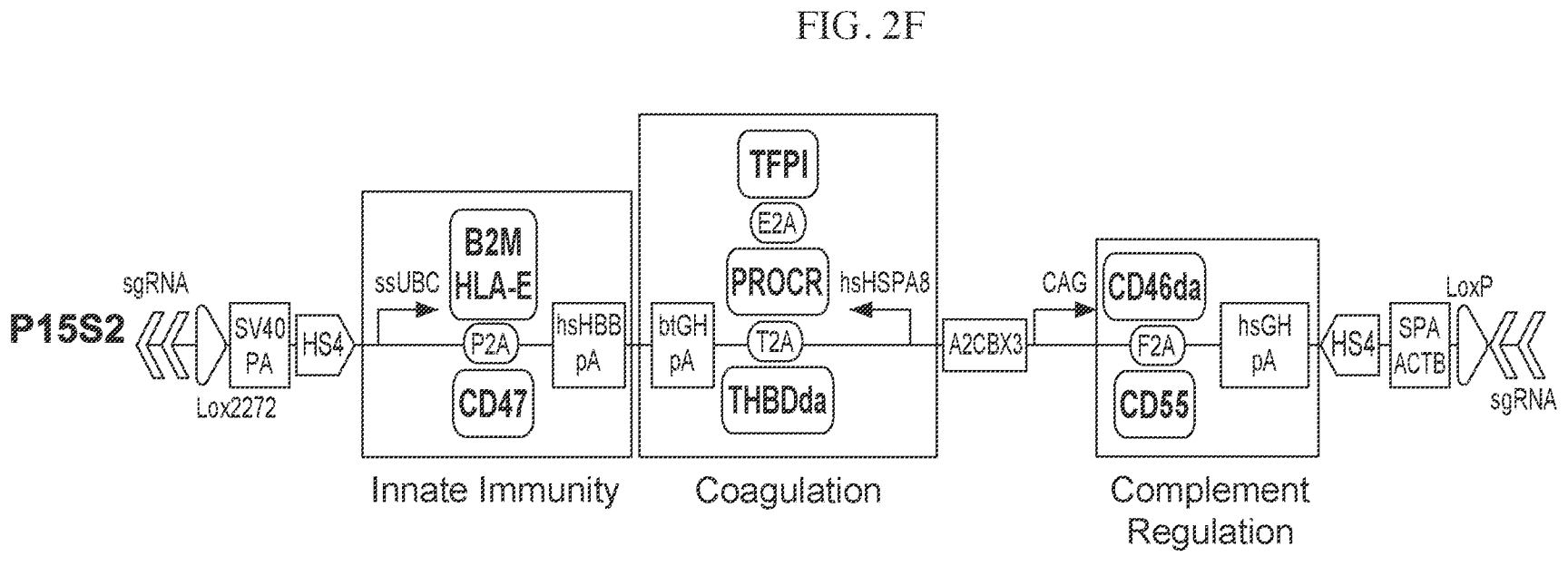

FIG. 2F illustrates an exemplary nucleic acid comprising an innate immunity cassette under the control of a ssUBC promoter comprising a B2M HLA-E fusion protein and CD47, a coagulation cassette under the control of a ssHSPA8 promoter comprising TFPI, PROCR, and THBDda, and a complement regulation cassette under the control of a CAG promoter comprising CD46da1 (denoted as CD46da) and CD55. Genes within each cassette are separated by nucleic acids encoding 2A peptides (E2A, T2A, F2A, P2A). Each cassette also contains a poly A sequence (e.g., hsHBB, btGH, or hsGH). An exemplary nucleic acid having the cassettes of FIG. 2F is SEQ ID NO. 32.

Figure 2G:
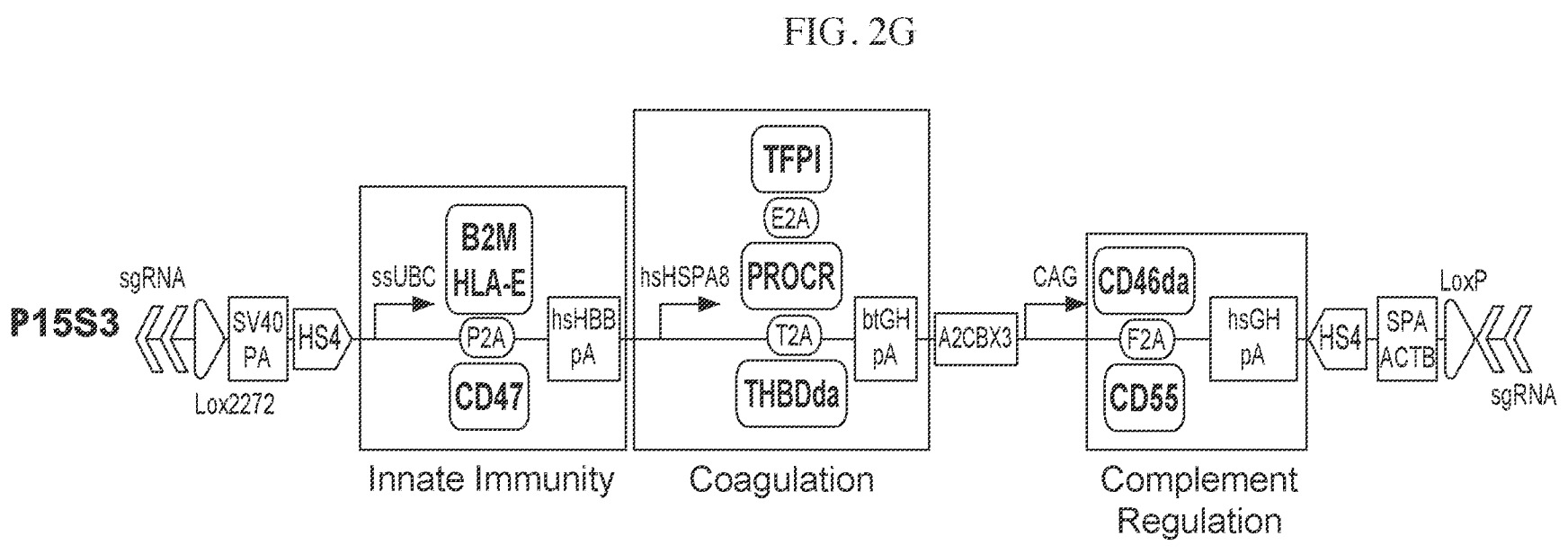

FIG. 2G illustrates an exemplary nucleic acid comprising an innate immunity cassette under the control of a ssUBC promoter comprising a B2M HLA-E fusion protein and CD47, a coagulation cassette under the control of a ssHSPA8 promoter comprising TFPI, PROCR, and THBDda and a complement regulation cassette under the control of a CAG promoter comprising CD46da1 (denoted as CD46da) and CD55. Genes within each cassette are separated by nucleic acids encoding 2A peptides (E2A, T2A, F2A, P2A). Each cassette also contains a poly A sequence (e.g., hsHBB, btGH, or hsGH). An exemplary nucleic acid having the cassettes of FIG. 2G is SEQ ID NO. 33.

Figure 2H:
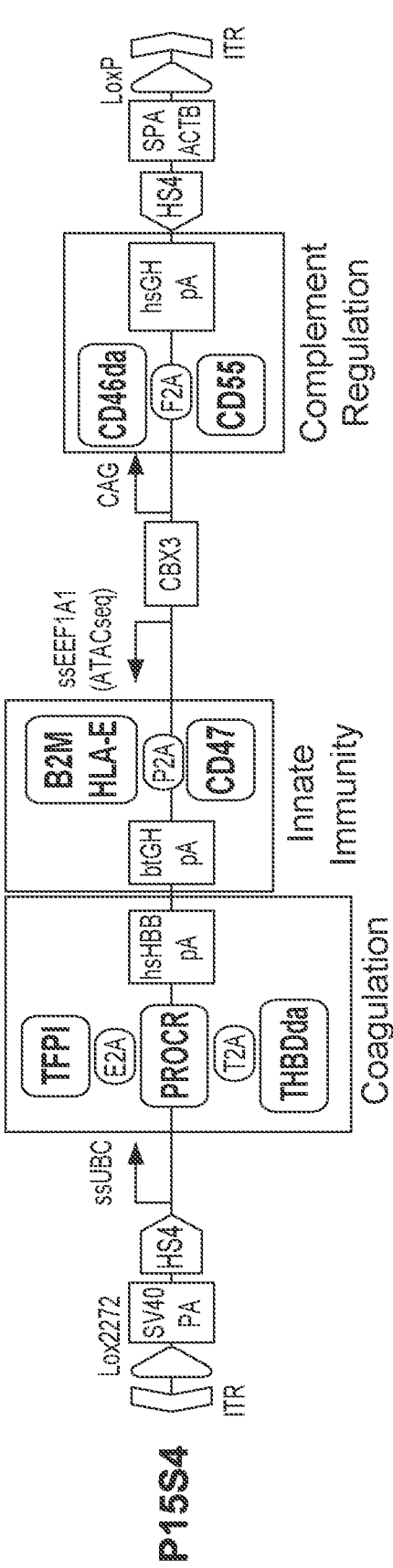

FIG. 2H illustrates an exemplary nucleic acid comprising a coagulation cassette under the control of a ssUBC promoter comprising TFPI, PROCR, and THBDda, an innate immunity cassette under the control of a ssEF1α1 (denoted ssEEF1α1 (ATACseq)) promoter comprising a B2M HLA-E fusion protein and CD47, and a complement regulation cassette under the control of a CAG promoter comprising CD46da1 (denoted as CD46da) and CD55. Genes within each cassette are separated by nucleic acids encoding 2A peptides (E2A, T2A, F2A, P2A). Each cassette also contains a poly A sequence (e.g., hsHBB, btGH, or hsGH). An exemplary nucleic acid having the cassettes of FIG. 2H is SEQ ID NO. 34.

FIG. 2I illustrates an exemplary nucleic acid comprising a coagulation and innate immunity cassette under the control of a ssUBC promoter comprising CD47-2, PROCR, and THBDda, an apoptosis and cell immunity cassette under the control of a ssHSPA8 promoter (denoted "ssHSPA8 (ATAC seq)") comprising ssA20 and ssHO1; and a complement regulation cassette under the control of a CAG promoter comprising CD46da, and CD55. Genes within each cassette are separated by nucleic acids encoding 2A peptides (P2A, P2A*) or IRES (e.g., IRES (FMDV) or IRES (EMCV)). Each cassette also contains a poly A sequence (e.g., hsHBB, btGH, or hsGH). An exemplary nucleic acid having the cassettes of FIG. 2I is SEQ ID NO. 174.

Figure 2J:
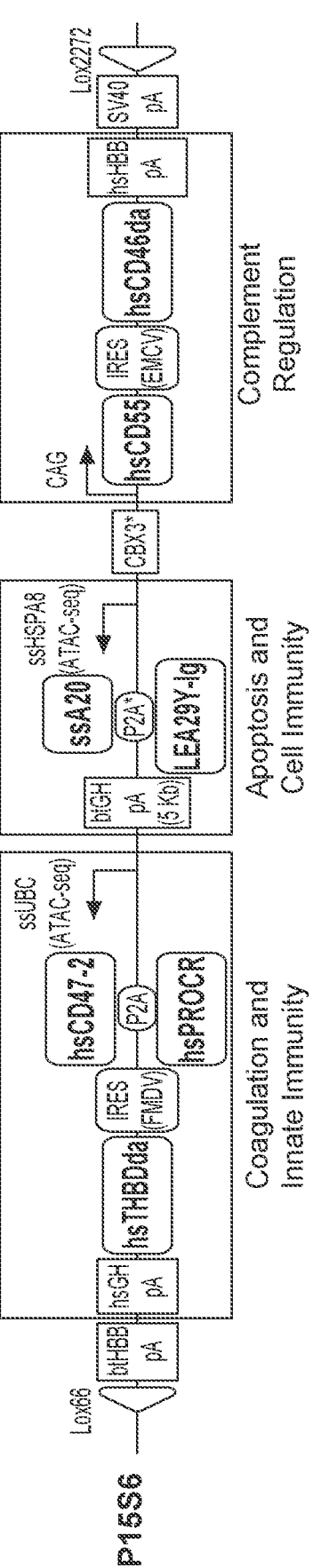

FIG. 2J illustrates an exemplary nucleic acid comprising a coagulation and innate immunity cassette under the control of a ssUBC promoter comprising CD47-2, PROCR, and THBDda, an apoptosis and cell immunity cassette under the control of a ssHSPA8 promoter (denoted "ssHSPA8 (ATAC seq)") comprising ssA20 and LEA29Y (denoted "LEA29Y-Ig"); and a complement regulation cassette under the control of a CAG promoter comprising CD46da, and CD55. Genes within each cassette are separated by nucleic acids encoding 2A peptides (P2A, P2A*) or IRES (e.g., IRES (FMDV) or IRES (EMCV)). Each cassette also contains a poly A sequence (e.g., hsHBB, btGH, or hsGH). An exemplary nucleic acid having the cassettes of FIG. 2J is SEQ ID NO. 175.

Figure 3A:
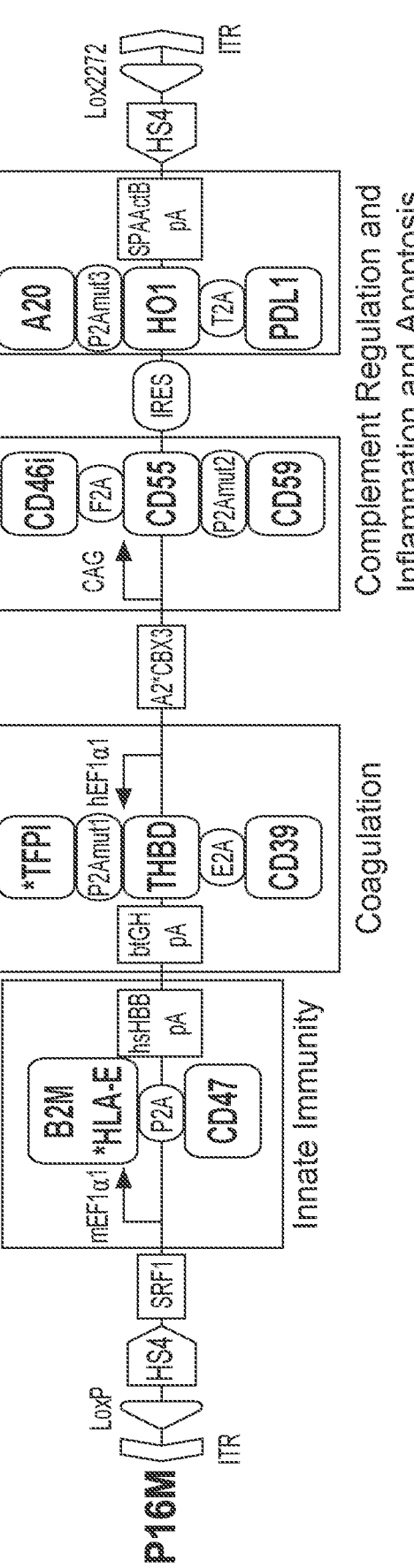

FIG. 3A illustrates an exemplary nucleic acid comprising an innate immunity cassette under the control of a mmEF1α1 (denoted mEF1α1) promoter comprising a B2M HLA-E fusion protein and CD47, a coagulation cassette under the control of a hEF1α1 promoter comprising TFPI, THBD, and CD39, and a complement regulation and inflammation and apoptosis cassette under the control of a CAG promoter comprising CD46i, CD55, CD59, A20, HO1, and PD-L1 (denoted PDL1). Genes within each cassette are separated by nucleic acids encoding 2A peptides (P2A, P2Amut1, E2A, F2A, P2Amut2, P2Amut3, T2A) or IRES. Each cassette also contains a poly A sequence (e.g., hsHBB, btGH, or SPAActB). An exemplary nucleic acid having the cassettes of FIG. 3A is SEQ ID NO. 35.

Figure 3B:
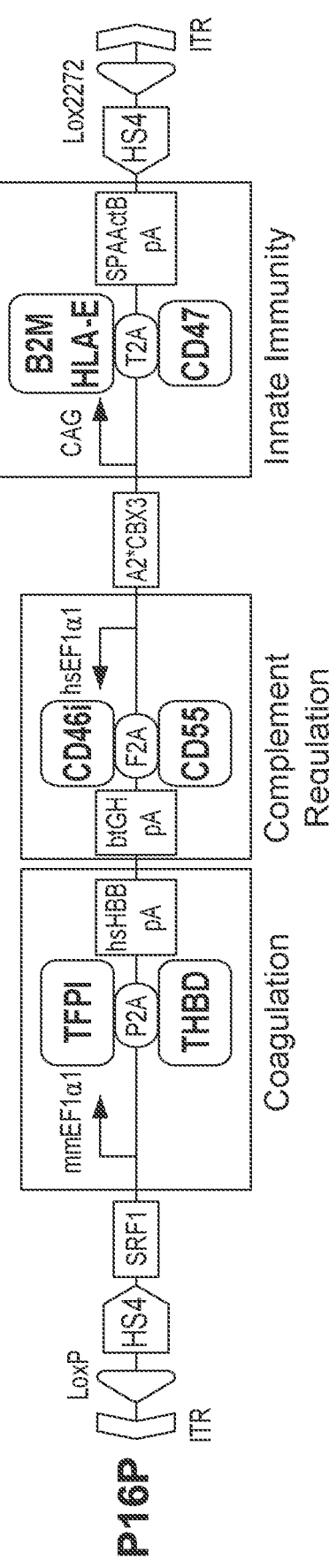

FIG. 3B illustrates an exemplary nucleic acid comprising a coagulation cassette under the control of a mmEF1α1 promoter comprising TFPI and THBD, a complement regulation cassette under the control of a hEF1α1 (denoted hsEF1α1) promoter comprising CD46i and CD55, an innate immunity cassette under the control of a CAG promoter comprising a B2M HLA-E fusion protein and CD47. Genes within each cassette are separated by nucleic acids encoding 2A peptides (T2A, F2A, P2A). Each cassette also contains a poly A sequence (e.g., hsHBB, btGH, or SPAActB). An exemplary nucleic acid having the cassettes of FIG. 3B is SEQ ID NO. 36.

Figure 3C:
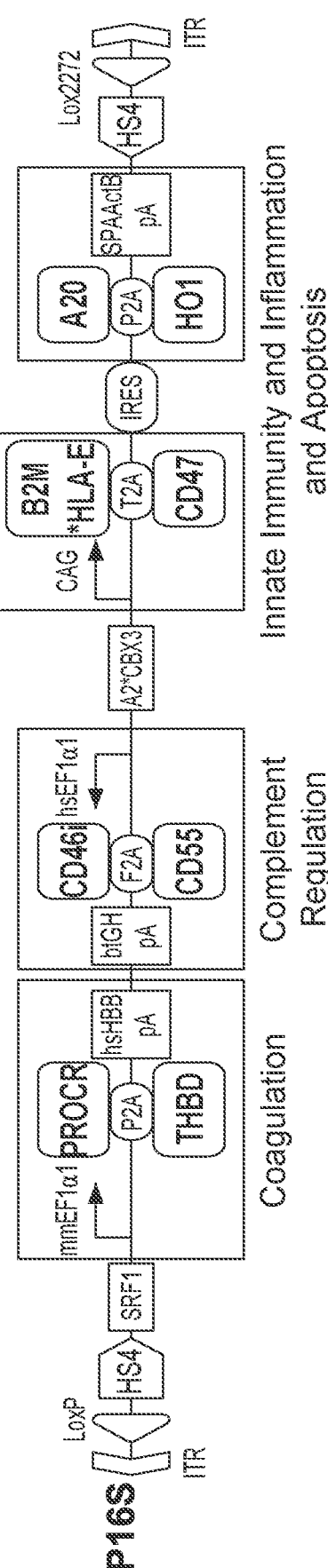

FIG. 3C illustrates an exemplary nucleic acid comprising a coagulation cassette under the control of a mmEF1α1 promoter comprising PROCR and THBD, a complement regulation cassette under the control of a hEF1α1 (denoted hsEF1α1) promoter comprising CD46i and CD55, an innate immunity and inflammation and apoptosis cassette under the control of a CAG promoter comprising a B2M HLA-E fusion protein, CD47, A20, and HO1. Genes within each cassette are separated by nucleic acids encoding 2A peptides (P2A, T2A, F2A) or IRES. Each cassette also contains a poly A sequence (e.g., hsHBB, btGH, or SPAActB). An exemplary nucleic acid having the cassettes of FIG. 3C is SEQ ID NO. 37.

Figure 4A:
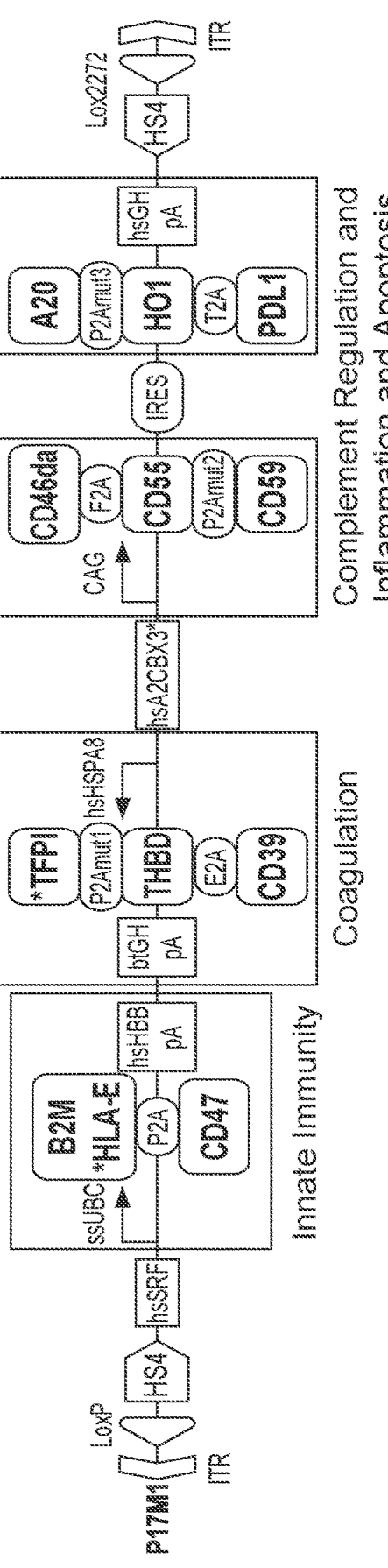

FIG. 4A illustrates an exemplary nucleic acid comprising an innate immunity cassette under the control of a ssUBC promoter comprising a B2M HLA-E fusion protein and CD47, a coagulation cassette under the control of a hsHSPA8 promoter comprising TFPI, THBD, and CD39, and a complement regulation and inflammation and apoptosis cassette under the control of a CAG promoter comprising CD46da1 (denoted as CD46da), CD55, CD59, A20, HO1, and PD-L1. Genes within each cassette are separated by nucleic acids encoding 2A peptides (E2A, P2A, P2Amut1, P2Amut2, P2Amut3, T2A, F2A) or IRES. Each cassette also contains a poly A sequence (e.g., hsHBB, btGH, or hsGH). An exemplary nucleic acid having the cassettes of FIG. 4A is SEQ ID NO. 38.

Figure 4B:
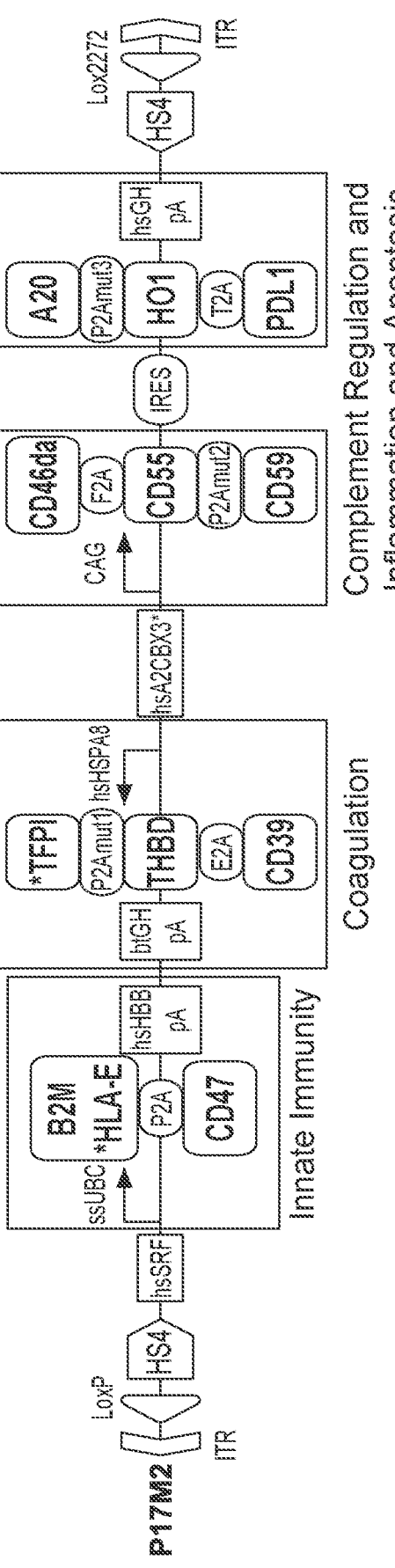

FIG. 4B illustrates an exemplary nucleic acid comprising an innate immunity cassette under the control of a ssUBC promoter comprising a B2M HLA-E fusion protein and CD47, a coagulation cassette under the control of a hsHSPA8 promoter comprising TFPI, THBD, and CD39, and a complement regulation and inflammation and apoptosis cassette under the control of a CAG promoter comprising CD46da2 (denoted as CD46da), CD55, CD59, A20, HO1, and PD-L1. Genes within each cassette are separated by nucleic acids encoding 2A peptides (E2A, P2A, P2Amut1, P2Amut2, P2Amut3, T2A, F2A) or IRES. Each cassette also contains a poly A sequence (e.g., hsHBB, btGH, or hsGH). An exemplary nucleic acid having the cassettes of FIG. 4B is SEQ ID NO. 39.

Figure 4C:
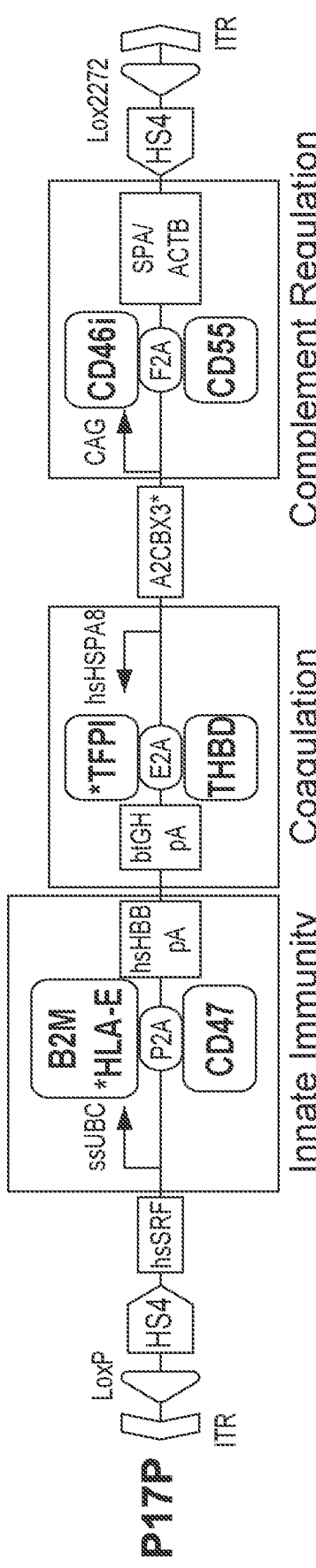

FIG. 4C illustrates an exemplary nucleic acid comprising an innate immunity cassette under the control of a ssUBC promoter comprising a B2M HLA-E fusion protein and CD47, a coagulation cassette under the control of a hsHSPA8 promoter comprising TFPI and THBD, and a complement regulation cassette under the control of a CAG promoter comprising CD46i and CD55. Genes within each cassette are separated by nucleic acids encoding 2A peptides (E2A, P2A, F2A). Each cassette also contains a poly A sequence (e.g., hsHBB, btGH, or SPA/ACTB). An exemplary nucleic acid having the cassettes of FIG. 4C is SEQ ID NO. 40.

Figure 4D:
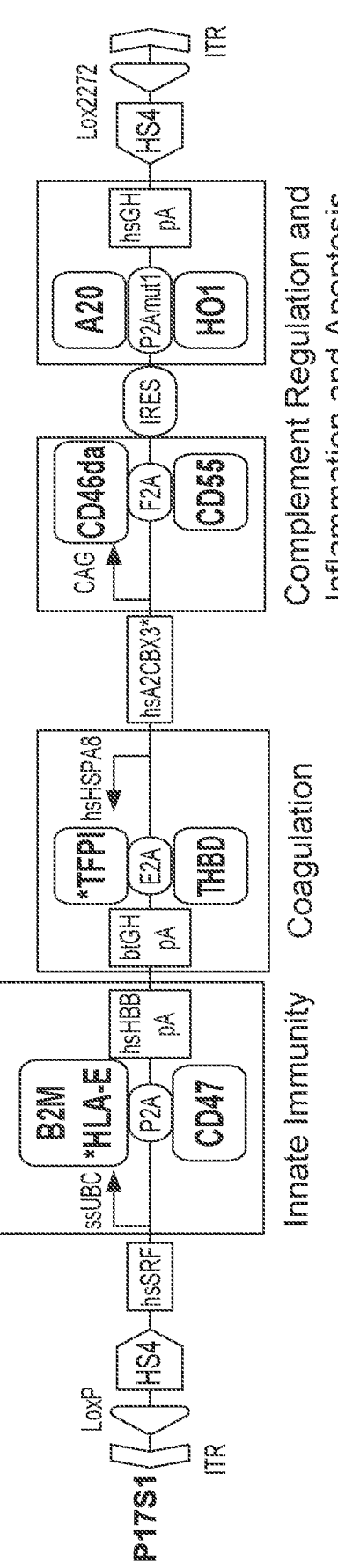

FIG. 4D illustrates an exemplary nucleic acid comprising an innate immunity cassette under the control of a ssUBC promoter comprising a B2M HLA-E fusion protein and CD47, a coagulation cassette under the control of a hsHSPA8 promoter comprising TFPI and THBD, and a complement regulation and inflammation and apoptosis cassette under the control of a CAG promoter comprising CD46da1 (denoted as CD46da), CD55, A20, and HO1. Genes within each cassette are separated by nucleic acids encoding 2A peptides (E2A, P2A, P2Amut1, F2A). Each cassette also contains a poly A sequence (e.g., hsHBB, btGH, or hsGH). An exemplary nucleic acid having the cassettes of FIG. 4D is SEQ ID NO. 41.

Figure 4E:
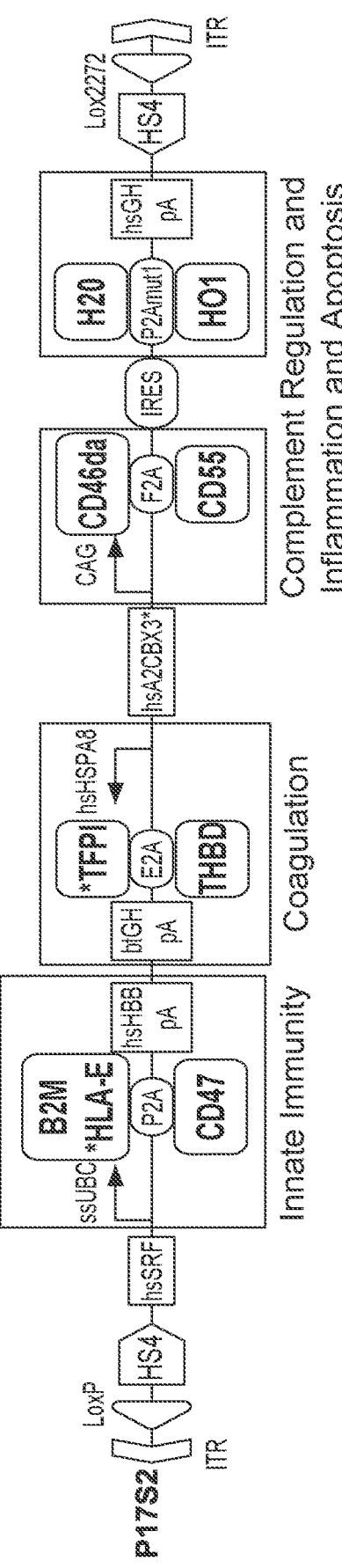

FIG. 4E illustrates an exemplary nucleic acid comprising an innate immunity cassette under the control of a ssUBC promoter comprising a B2M HLA-E fusion protein and CD47, a coagulation cassette under the control of a hsHSPA8 promoter comprising TFPI and THBD, and a complement regulation and inflammation and apoptosis cassette under the control of a CAG promoter comprising CD46da2 (denoted as CD46da), CD55, A20, and HO1. Genes within each cassette are separated by nucleic acids encoding 2A peptides (E2A, P2A, P2Amut1, F2A) or IRES. Each cassette also contains a poly A sequence (e.g., hsHBB, btGH, or hsGH). An exemplary nucleic acid having the cassettes of FIG. 4E is SEQ ID NO. 42.

Figure 4F:
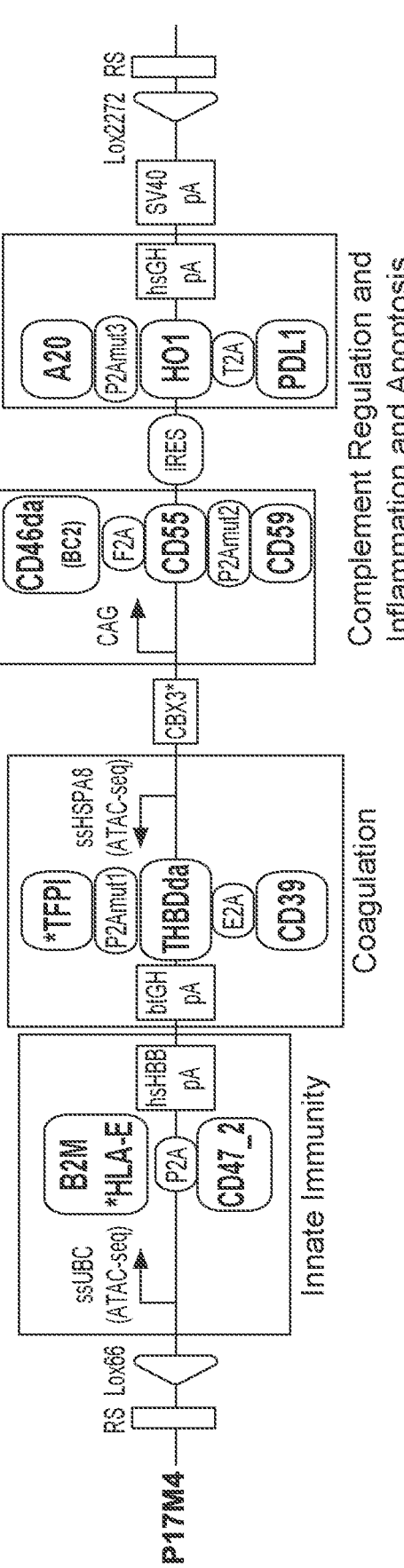

FIG. 4F illustrates an exemplary nucleic acid comprising an innate immunity cassette under the control of a ssUBC promoter comprising a B2M HLA-E fusion protein and CD47 (denoted CD47_2), a coagulation cassette under the control of a ssHSPA8 promoter comprising TFPI, THBD, and CD39, and a complement regulation and inflammation and apoptosis cassette under the control of a CAG promoter comprising CD46da2 (denoted as CD46da), CD55, CD59, A20, HO1, and PD-L1. Genes within each cassette are separated by nucleic acids encoding 2A peptides (P2A, P2Amut1, E2A, F2A, P2Amut2, PTAmut3, T2A) or IRES. Each cassette also contains a poly A sequence (e.g., hsHBB, btGH, or hsGH). An exemplary nucleic acid having the cassettes of FIG. 4F is SEQ ID NO. 173.

Figure 4G:
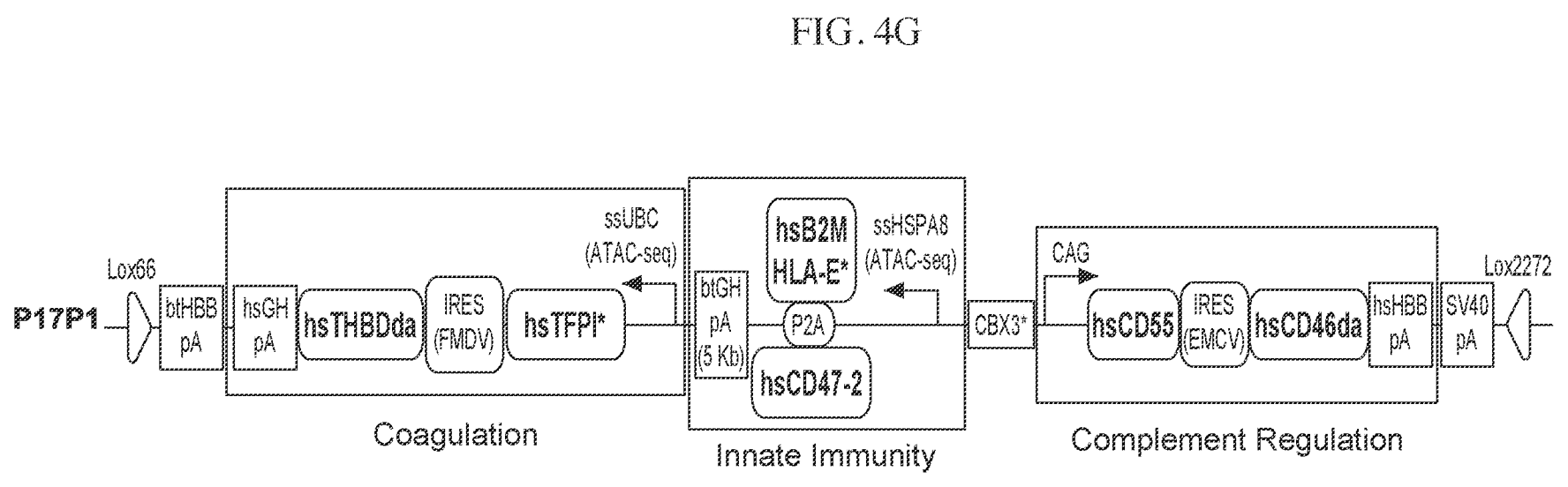

FIG. 4G illustrates an exemplary nucleic acid comprising a coagulation cassette under the control of a ssUBC promoter comprising TFPI (denoted "TFPI*") and THBDda, an innate immunity cassette under the control of a ssHSPA8 promoter (denoted "ssHSPA8 (ATAC seq)") comprising a B2M HLA-E fusion protein and CD47-2; and a complement regulation cassette under the control of a CAG promoter comprising CD46da and CD55. Genes within each cassette are separated by nucleic acids encoding 2A peptides (P2A) or IRES (e.g., IRES (FMDV) or IRES (EMCV)). Each cassette also contains a poly A sequence (e.g., hsHBB, btGH, or hsGH). An exemplary nucleic acid having the cassettes of FIG. 4G is SEQ ID NO. 176.

Figure 4H:
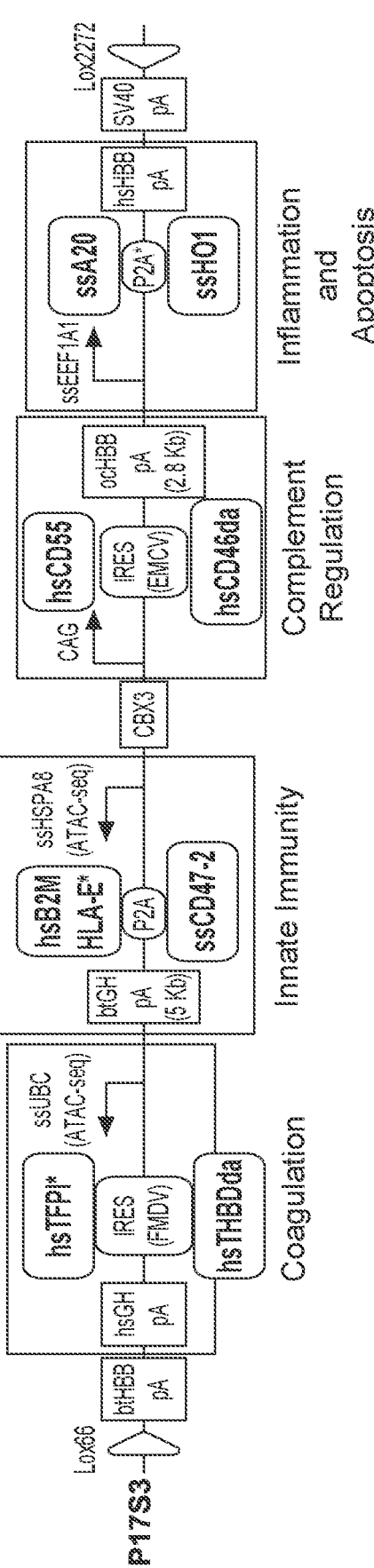

FIG. 4H illustrates an exemplary nucleic acid comprising a coagulation cassette under the control of a ssUBC promoter comprising TFPI (TFPI*) and THBDda; an innate immunity cassette under the control of a ssHSPA8 promoter (denoted "ssHSPA8 (ATAC seq)") comprising a B2M HLA-E fusion protein and CD47-2; a complement regulation cassette under the control of a CAG promoter comprising CD46da, and CD55; and an inflammation and apoptosis cassette under the control of a ssEF1α1 promoter (denoted "ssEEF1A1"). Genes within each cassette are separated by nucleic acids encoding 2A peptides (P2A, P2A*) or IRES (e.g., IRES (FMDV) or IRES (EMCV)). Each cassette also contains a poly A sequence (e.g., hsHBB, ocHBB, btGH, or hsGH). An exemplary nucleic acid having the cassettes of FIG. 4H is SEQ ID NO. 177.

Figure 5A:
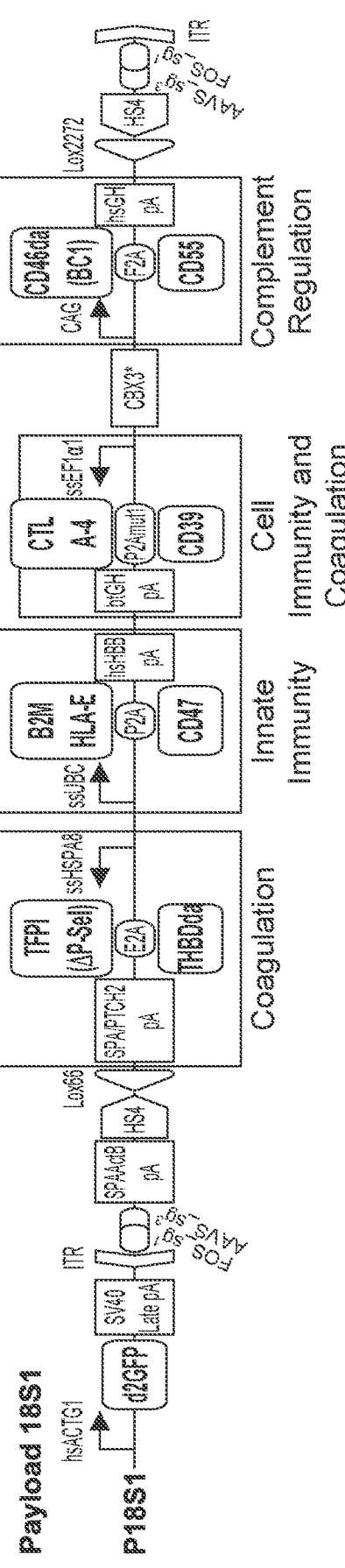

FIG. 5A illustrates an exemplary nucleic acid comprising a coagulation cassette under the control of a ssHSPA8 promoter comprising TFPI (ΔP-Sel) and THBDda, an innate immunity cassette under the control of a ssUBC promoter comprising a B2M HLA-E fusion protein and CD47, a cell immunity and coagulation cassette under the control of a ssEF1α1 promoter comprising CTLA-4 (e.g. LEA29Y) and CD39, and a complement regulation cassette under the control of a CAG promoter comprising CD46da1 (denoted as CD46da (BC1)) and CD55. This nucleic acid further comprises a GFP (labeled d2GFP) 5' to the coagulation cassette. Genes within each cassette are separated by nucleic acids encoding 2A peptides (E2A, P2A, P2Amut1, F2A). Each cassette also contains a poly A sequence (e.g., SPA/PTCH2 pA, hsHBB, btGH, or hsGH). An exemplary nucleic acid having the cassettes of FIG. 5A is SEQ ID NO. 43.

Figure 5B:
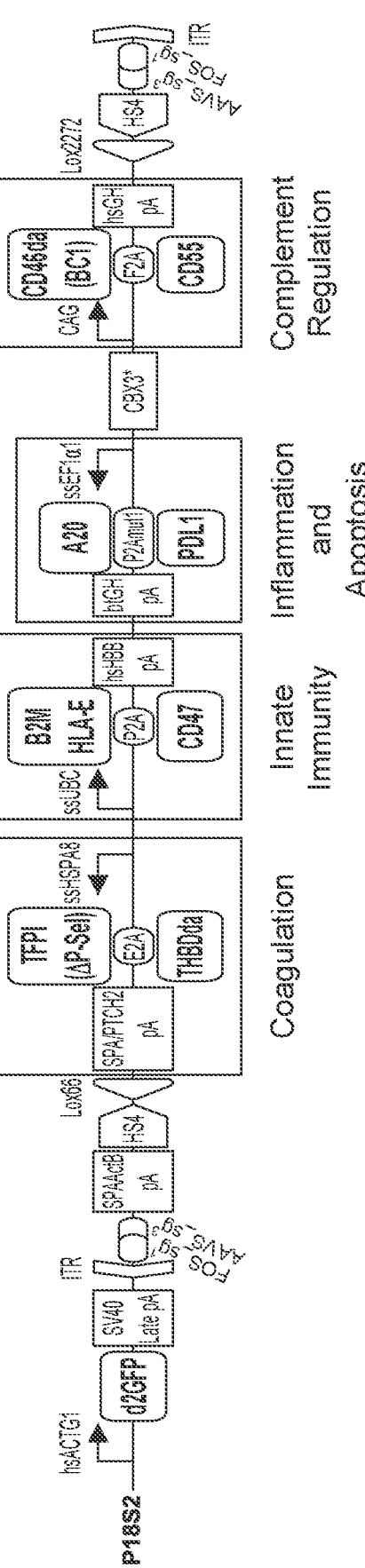

FIG. 5B illustrates an exemplary nucleic acid comprising a coagulation cassette under the control of a ssHSPA8 promoter comprising TFPI (ΔP-Sel) and THBDda, an innate immunity cassette under the control of a ssUBC promoter comprising a B2M HLA-E fusion protein and CD47, an inflammation and apoptosis cassette under the control of a ssEF1α1 promoter comprising A20 and PD-L1, and a complement regulation cassette under the control of a CAG promoter comprising CD46da1 (denoted as CD46da (BC1)) and CD55. This nucleic acid further comprises a GFP (labeled d2GFP) 5' to the coagulation cassette. Genes within each cassette are separated by nucleic acids encoding 2A peptides (E2A, P2A, P2Amut1, F2A). Each cassette also contains a poly A sequence (e.g., SPA/PTCH2, hsHBB, btGH, or hsGH). An exemplary nucleic acid having the cassettes of FIG. 5B is SEQ ID NO. 44.

Figure 5C:
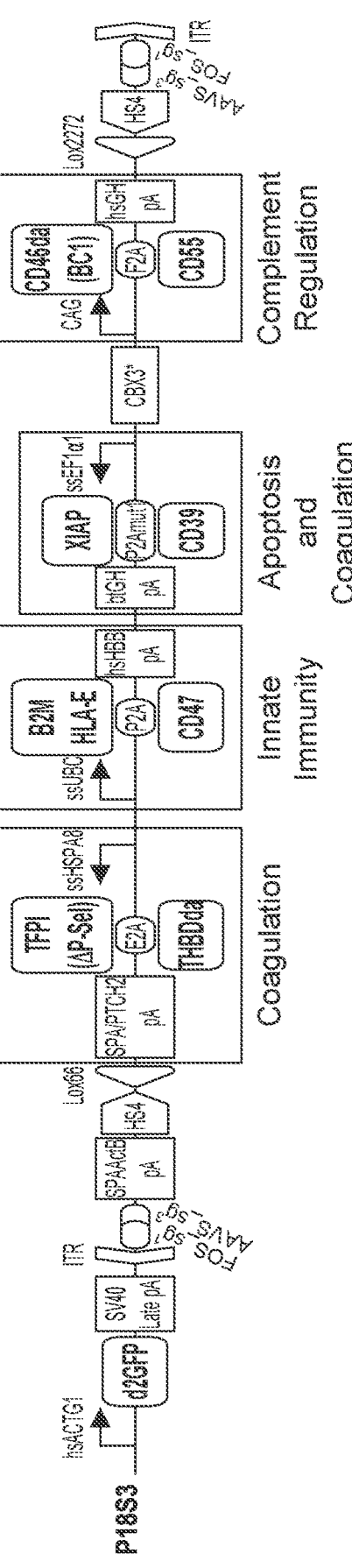

FIG. 5C illustrates an exemplary nucleic acid comprising a coagulation cassette under the control of a ssHSPA8 promoter comprising TFPI (ΔP-Sel) and THBDda, an innate immunity cassette under the control of a ssUBC promoter comprising a B2M HLA-E fusion protein and CD47, an apoptosis and coagulation cassette under the control of a ssEF1α1 promoter comprising XIAP and CD39, and a complement regulation cassette under the control of a CAG promoter comprising CD46da1 (denoted as CD46da (BC1)) and CD55. This nucleic acid further comprises a GFP (labeled d2GFP) 5' to the coagulation cassette. Genes within each cassette are separated by nucleic acids encoding 2A peptides (E2A, P2A, P2Amut1, F2A). Each cassette also contains a poly A sequence (e.g., SPA/PTCH2, hsHBB, btGH, or hsGH). An exemplary nucleic acid having the cassettes of FIG. 5C is SEQ ID NO. 45.

Figure 5D:
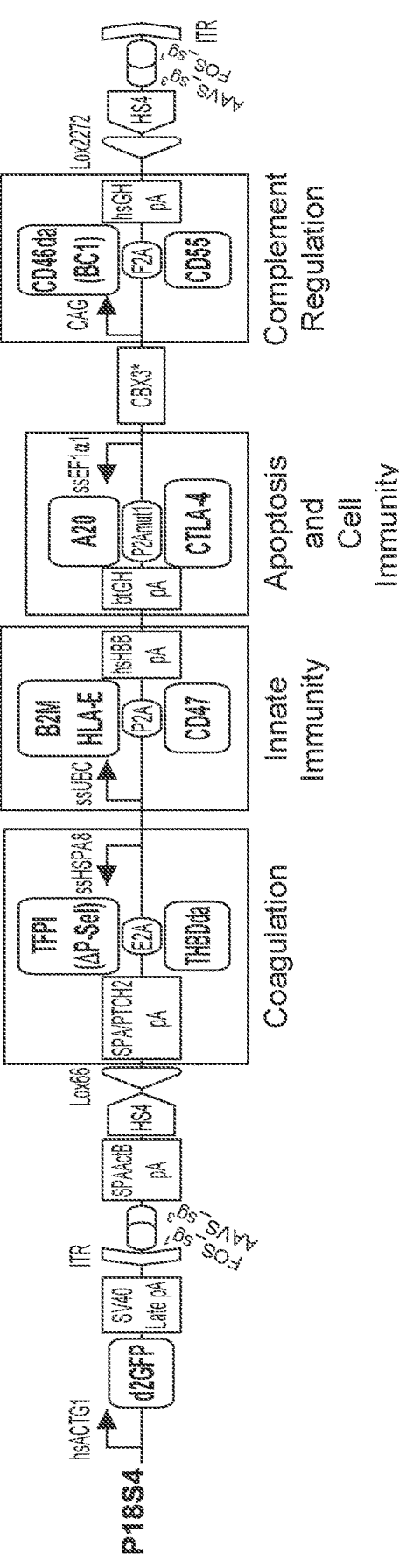

FIG. 5D illustrates an exemplary nucleic acid comprising a coagulation cassette under the control of a ssHSPA8 promoter comprising TFPI (ΔP-Sel) and THBDda, an innate immunity cassette under the control of a ssUBC promoter comprising a B2M HLA-E fusion protein and CD47, an apoptosis and cell immunity cassette under the control of a ssEF1α1 promoter comprising CTLA-4 (e.g., LEA29Y) and A20, and a complement regulation cassette under the control of a CAG promoter comprising CD46da1 (denoted as CD46da (BC1)) and CD55. This nucleic acid further comprises a GFP (labeled d2GFP) 5' to the coagulation cassette. Genes within each cassette are separated by nucleic acids encoding 2A peptides (E2A, P2A, P2Amut1, F2A). Each cassette also contains a poly A sequence (e.g., SPA/PTCH2, hsHBB, btGH, or hsGH). An exemplary nucleic acid having the cassettes of FIG. 5D is SEQ ID NO. 46.

Figure 5E:
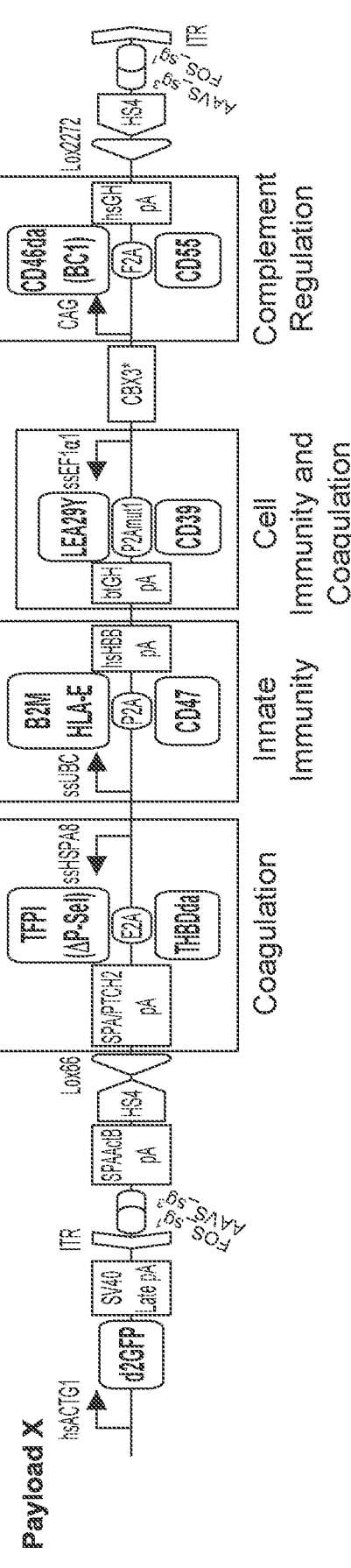

FIG. 5E illustrates an exemplary nucleic acid comprising a coagulation cassette under the control of a ssHSPA8 promoter comprising TFPI (ΔP-Sel) and THBDda, an innate immunity cassette under the control of a ssUBC promoter comprising a B2M HLA-E fusion protein and CD47, a cell immunity and coagulation cassette under the control of a ssEF1α1 promoter comprising LEA29Y and CD39, and a complement regulation cassette under the control of a CAG promoter comprising CD46da1 (denoted as CD46da (BC1)) and CD55. This nucleic acid further comprises a GFP (labeled d2GFP) 5' to the coagulation cassette. Genes within each cassette are separated by nucleic acids encoding 2A peptides (E2A, P2A, P2Amut1, F2A). Each cassette also contains a poly A sequence (e.g., SPA/PTCH2 pA, hsHBB, btGH, or hsGH). An exemplary nucleic acid having the cassettes of FIG. 5A is SEQ ID NO. 43.

Figure 5F:
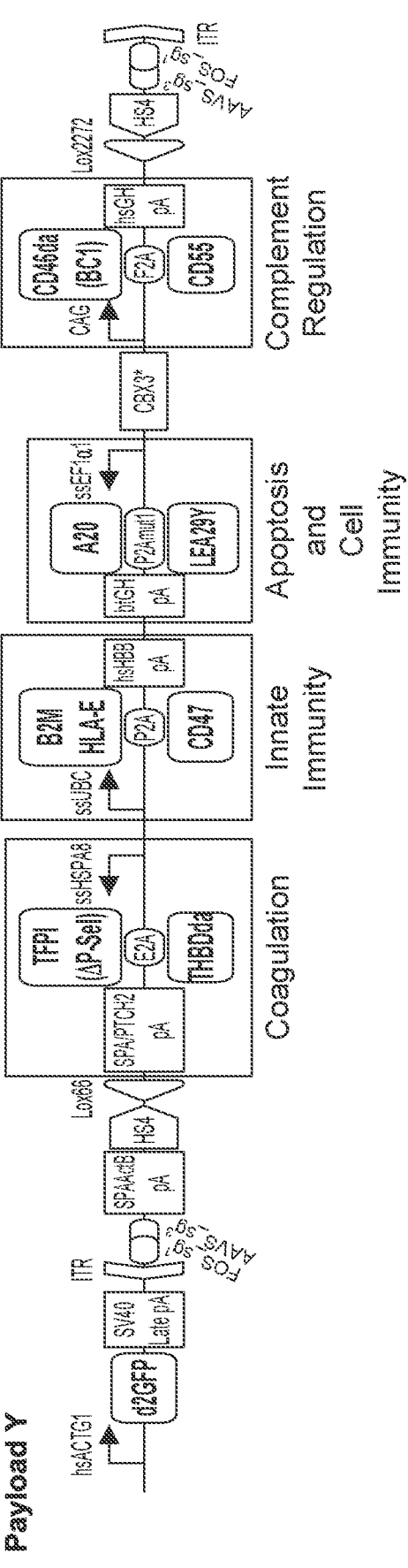

FIG. 5F illustrates an exemplary nucleic acid comprising a coagulation cassette under the control of a ssHSPA8 promoter comprising TFPI (ΔP-Sel) and THBDda, an innate immunity cassette under the control of a ssUBC promoter comprising a B2M HLA-E fusion protein and CD47, an apoptosis and cell immunity cassette under the control of a ssEF1α1 promoter comprising LEA29Y and A20, and a complement regulation cassette under the control of a CAG promoter comprising CD46da1 (denoted as CD46da (BC1)) and CD55. This nucleic acid further comprises a GFP (labeled d2GFP) 5' to the coagulation cassette. Genes within each cassette are separated by nucleic acids encoding 2A peptides (E2A, P2A, P2Amut1, F2A). Each cassette also contains a poly A sequence (e.g., SPA/PTCH2, hsHBB, btGH, or hsGH). An exemplary nucleic acid having the cassettes of FIG. 5D is SEQ ID NO. 46.

Figure 6:
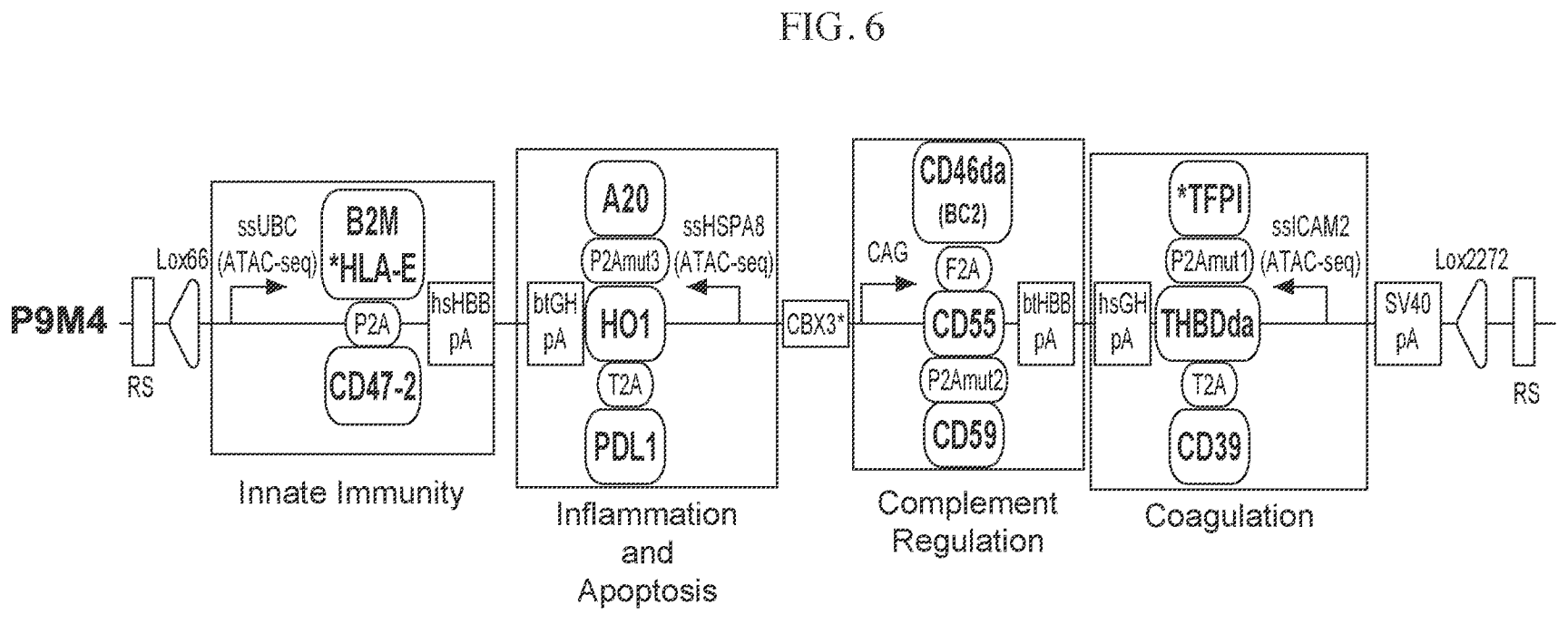

FIG. 6 illustrates an exemplary nucleic acid comprising an innate immunity cassette under the control of a ssUBC promoter comprising a B2M HLA-E fusion protein and CD47 (denoted CD47-2), an inflammation and apoptosis cassette under the control of a hsHSPA8 promoter comprising A20, HO1, and PD-L1, a complement regulation cassette under the control of a CAG promoter comprising CD46da2 (denoted as CD46da (BC2)), CD55, and CD59, and a coagulation cassette under the control of a ssICAM2 promoter comprising TFPI (denoted *TFPI), CD39, and THBDda. Genes within each cassette are separated by nucleic acids encoding 2A peptides (P2A, P2Amut3, T2A, F2A, P2Amut2, P2Amut1, and E2A). Each cassette also contains a poly A sequence (e.g., hsHBB, btGH (labeled "btGH"), btHBB, and hsGH). An exemplary nucleic acid having the cassettes of FIG. 6 is SEQ ID NO. 172.

Figure 7A:
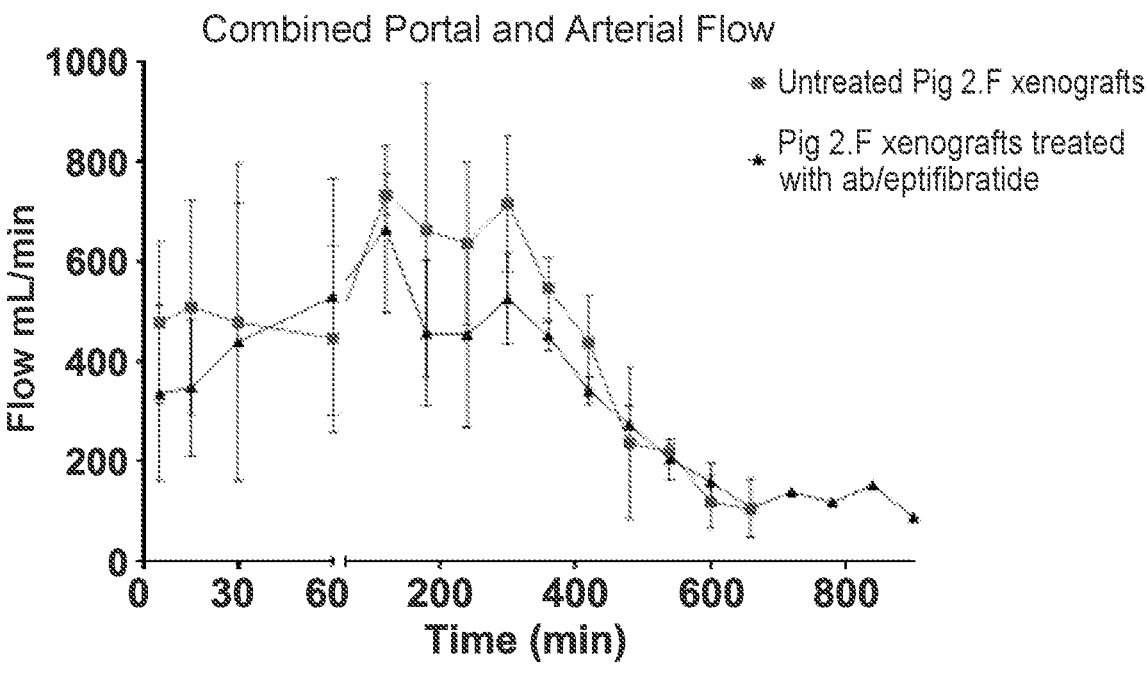

FIG. 7A shows the combined artery and portal venous flow in porcine liver xenografts comprising nucleic acids comprising the polycistronic cassettes of FIG. 2D treated with or without anti-GPIb fragmented murine antibody and the GPIIb/IIIa inhibitor eptifibatide (ab/eptifibatide).

Figure 7B:
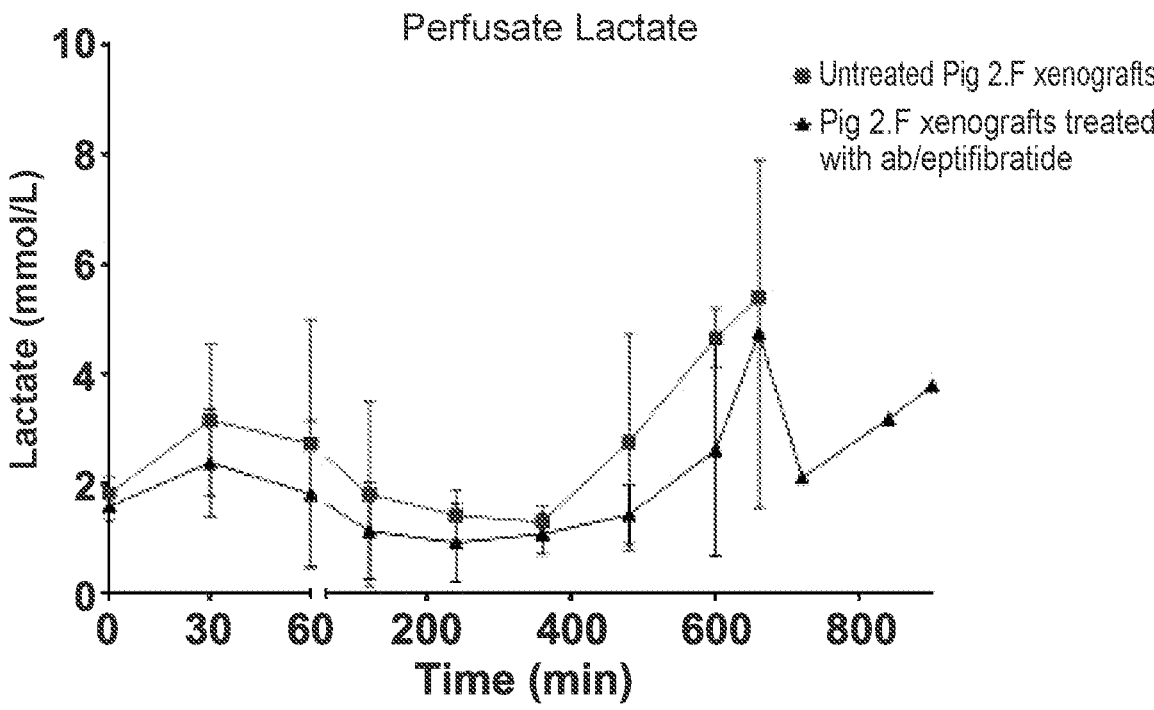

FIG. 7B shows the lactate clearance in porcine liver xenografts comprising nucleic acids comprising the polycistronic cassettes of FIG. 2D treated with or without anti-GPIb fragmented murine antibody and the GPIIb/IIIa inhibitor eptifibatide (ab/eptifibatide).

Figure 8A:
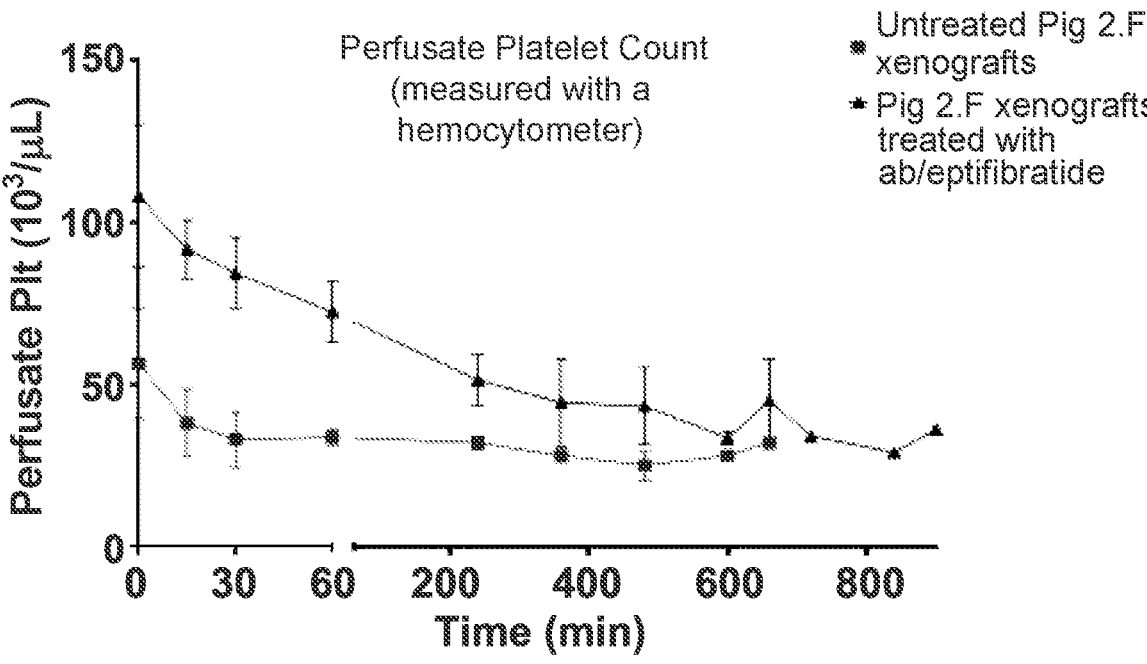

FIG. 8A shows the platelet count in porcine liver xenografts treated with or without anti-GPIb fragmented murine antibody and the GPIIb/IIIa inhibitor eptifibatide (ab/eptifibatide) over time, as measured by a hemocytometer.

Figure 8B:
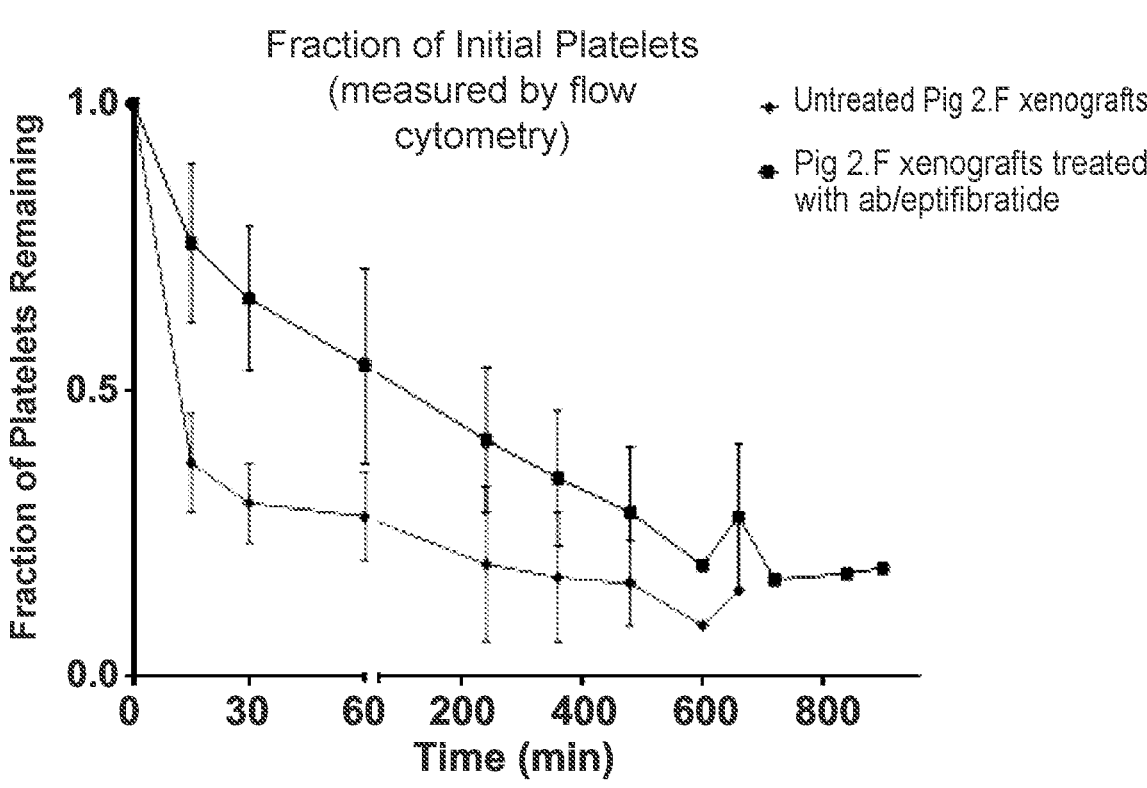

FIG. 8B shows the platelet count in porcine liver xenografts treated with or without anti-GPIb fragmented murine antibody and the GPIIb/IIIa inhibitor eptifibatide (ab/eptifibatide) over time, as measured by flow cytometry.

Figure 9A:
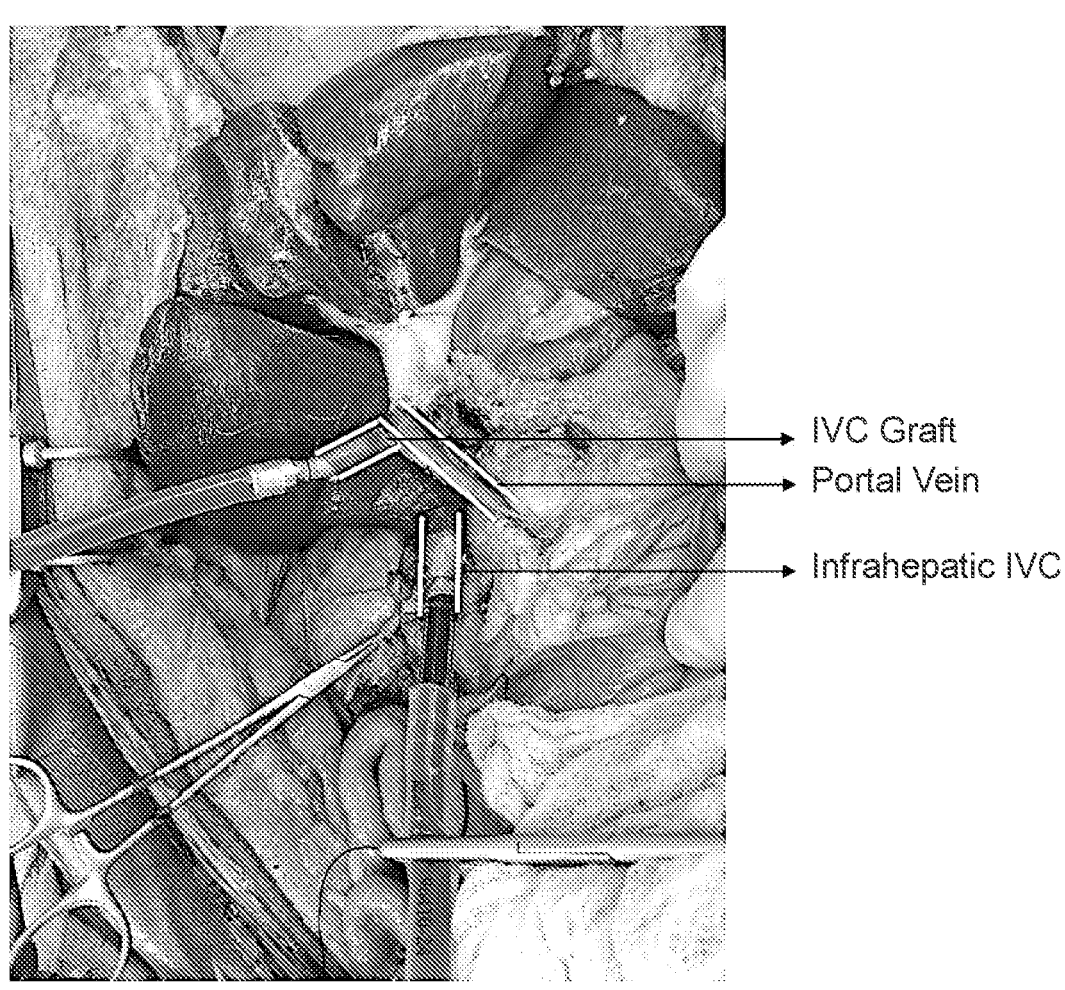

FIG. 9A shows an image of a porcine liver xenograft. The suprahepatic inferior vena cava (IVC) and portal vein are indicated in the image.

Figure 9B:
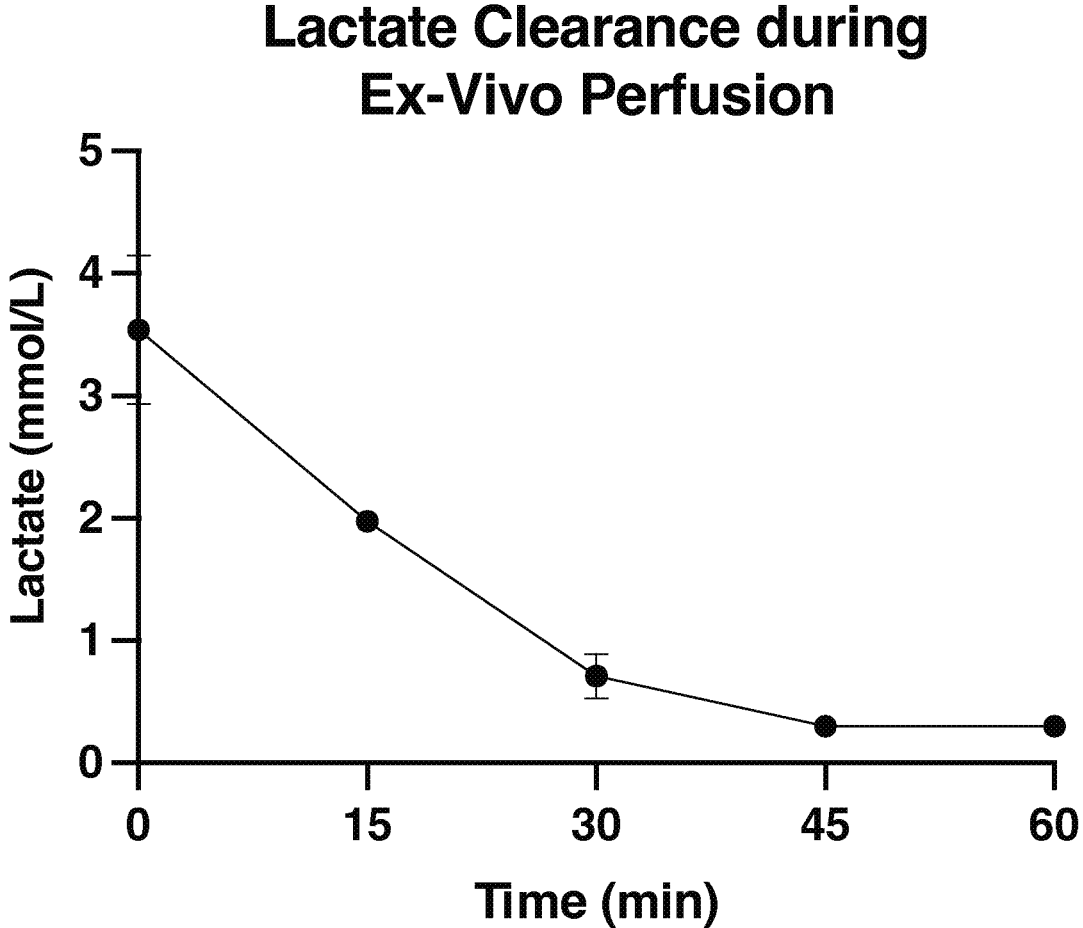

FIG. 9B shows the lactate clearance in porcine liver xenografts during ex-vivo normothermic perfusion of a porcine liver xenograft.

Figure 10A:
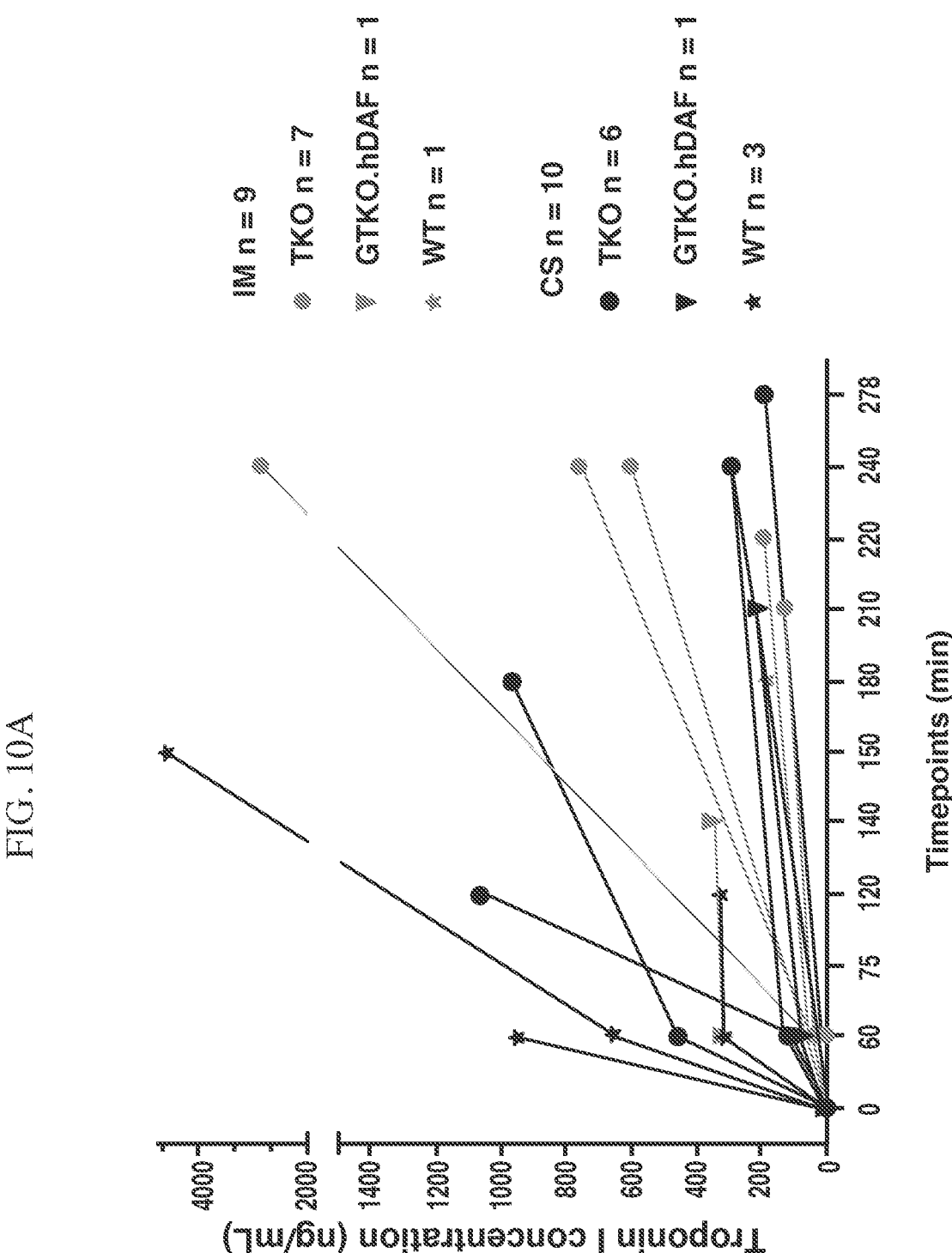

FIG. 10A shows mean troponin I concentration (ng/mL) over time in cardiac xenografts that are stored in a cold preservation solution (CS) or perfused with oxygenated Steen's solution with red blood cells (IM). The following cardiac xenografts were studied: (a) cardiac xenografts containing knockouts of GGTA1, CMAH, and B4GALNT2 with variable expression of human complement and thrombo-regulatory genes ("TKO"); (b) cardiac xenografts containing GGTA1 knockout and expression of CD55 ("GT-KO.hDAF"); and (c) wild-type cardiac xenografts "WT".

Figure 10B:
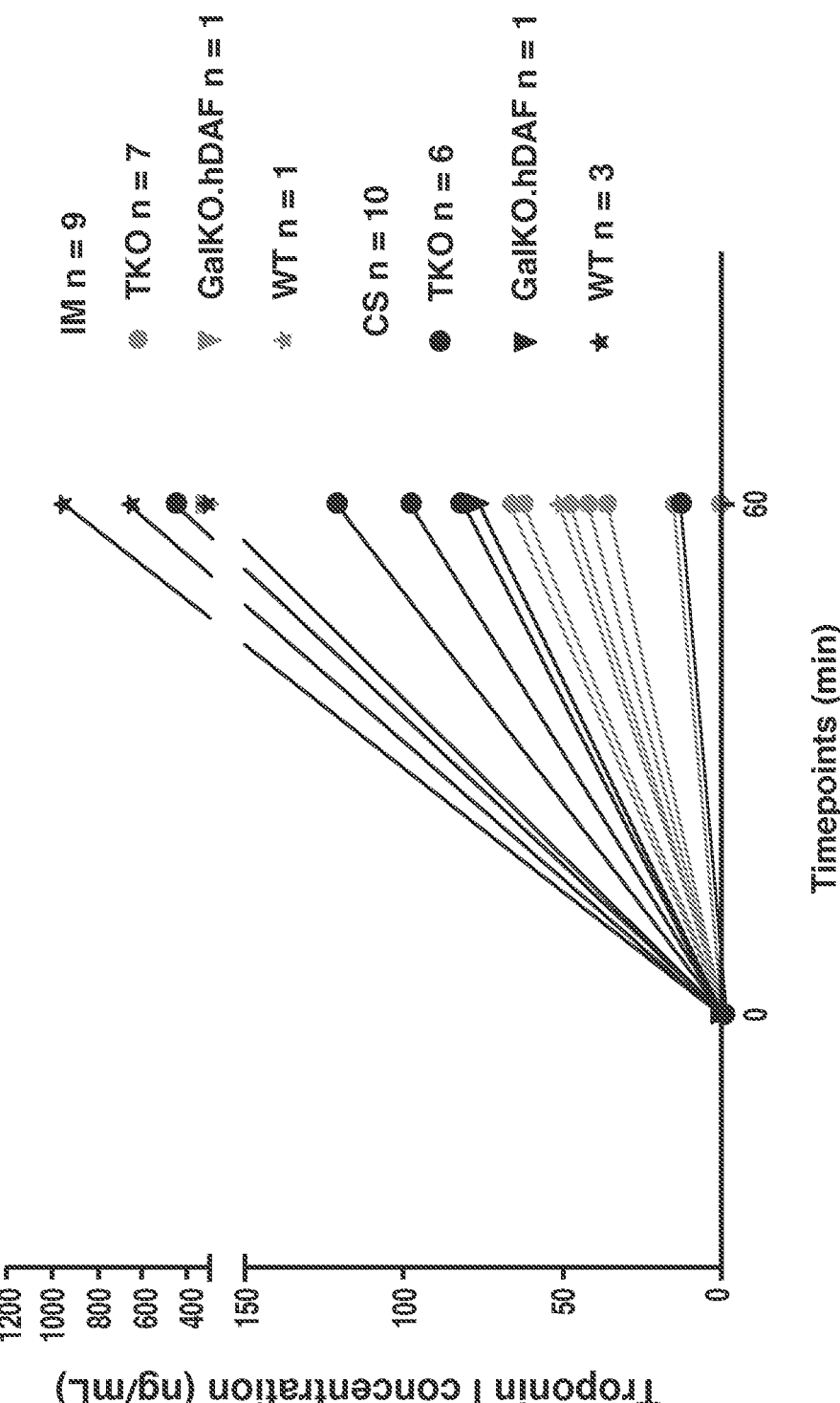

FIG. 10B shows mean troponin I concentration (ng/mL) over 1 hour in cardiac xenografts that are stored in a cold preservation solution (CS) or perfused with oxygenated Steen's solution with red blood cells (IM). The following cardiac xenografts were studied: (a) cardiac xenografts containing knockouts of GGTA1, CMAH, and B4GALNT2 with variable expression of human complement and thrombo-regulatory genes ("TKO"); (b) cardiac xenografts containing a GGTA1 knockout and expression of CD55 ("GTKO.hDAF"); and (c) wild-type cardiac xenografts "WT".

Figure 10C:
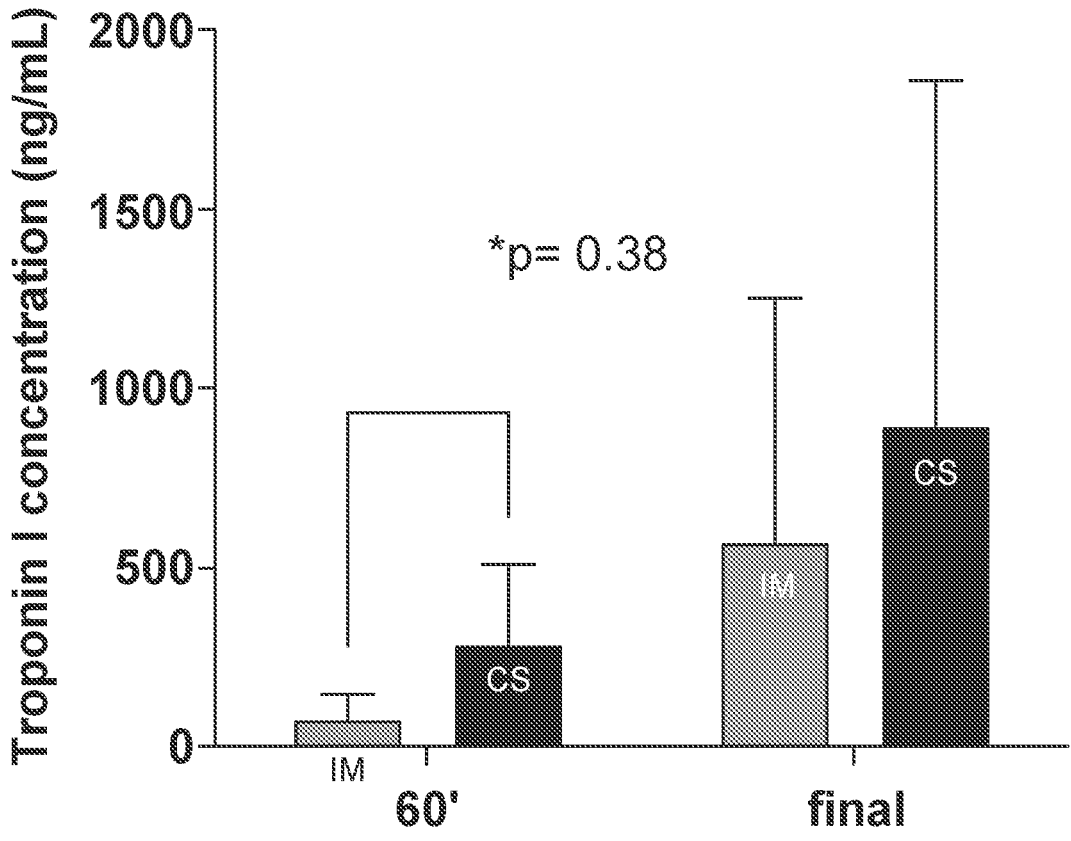

FIG. 10C is a graph of troponin I concentration (ng/mL) at 1 hour and at the final timepoint in cardiac xenografts that are stored in a cold preservation solution (CS) or perfused with oxygenated Steen's solution with red blood cells (IM).

Figure 11A:
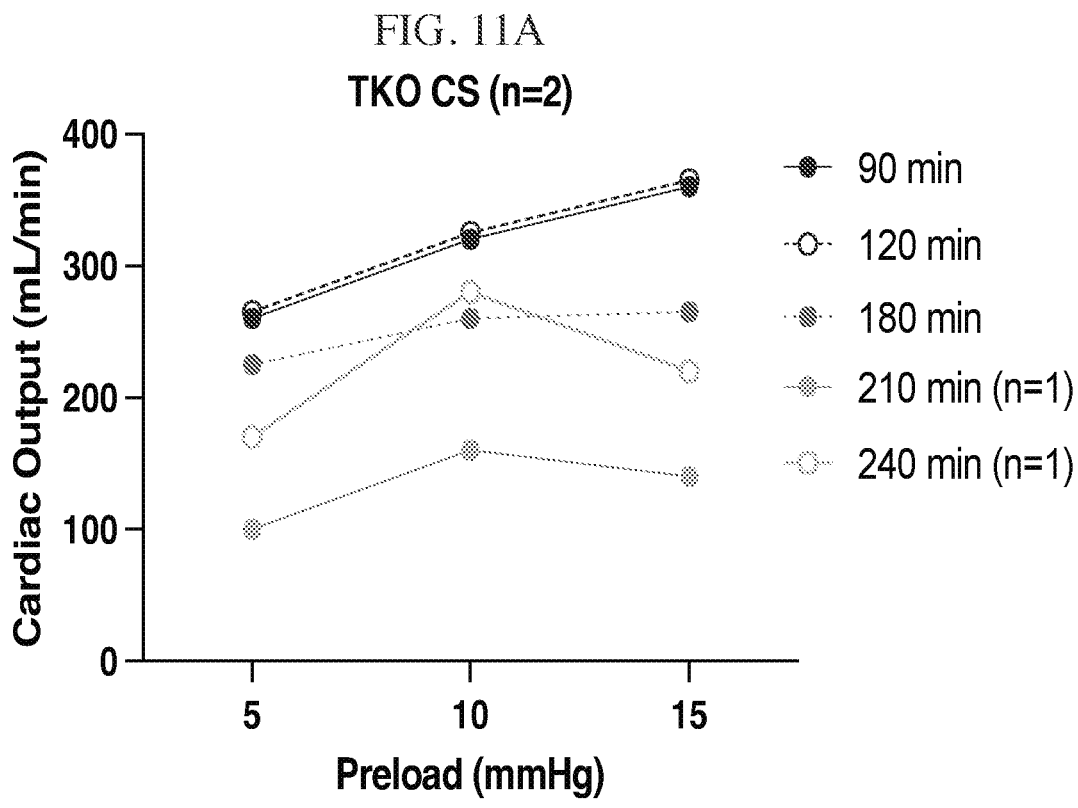

FIG. 11A is a graph showing cardiac output over time in TKO cardiac xenografts that are stored in a cold preservation solution (CS).

Figure 11B:
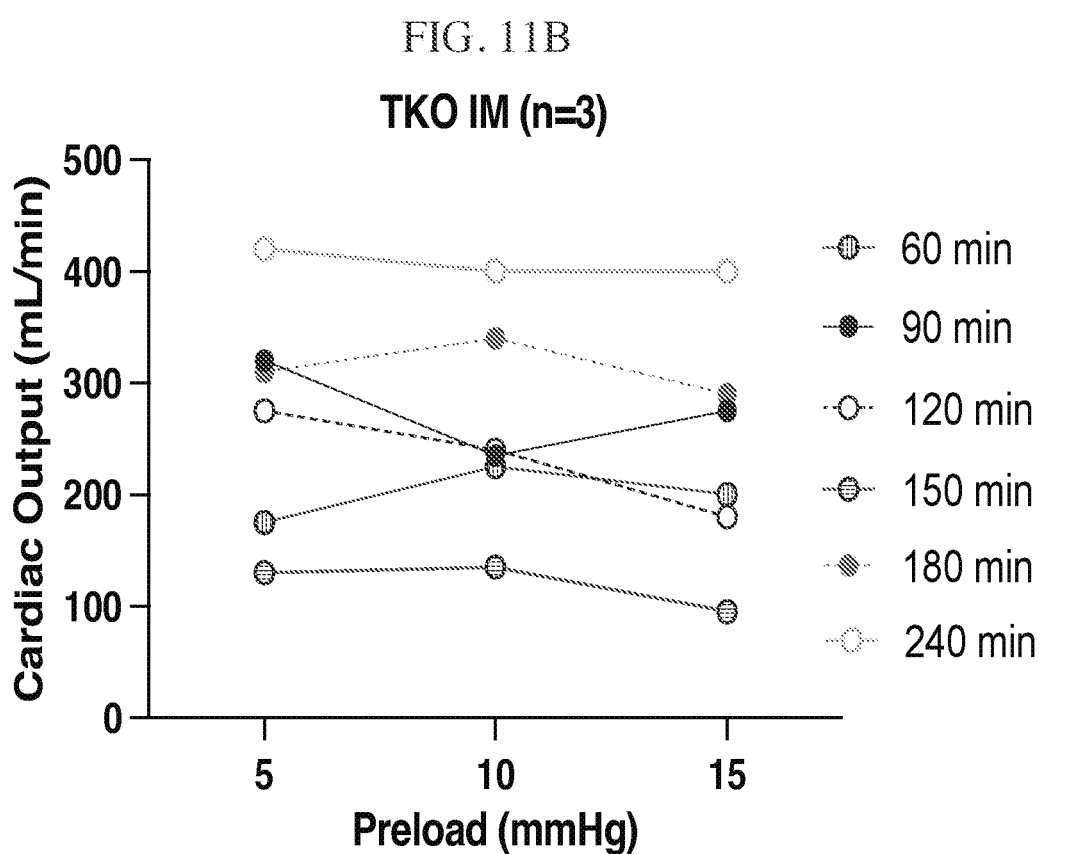

FIG. 11B is a graph showing cardiac output over time in TKO cardiac xenografts that are perfused with oxygenated Steen's solution with red blood cells (IM).

Figure 11C:
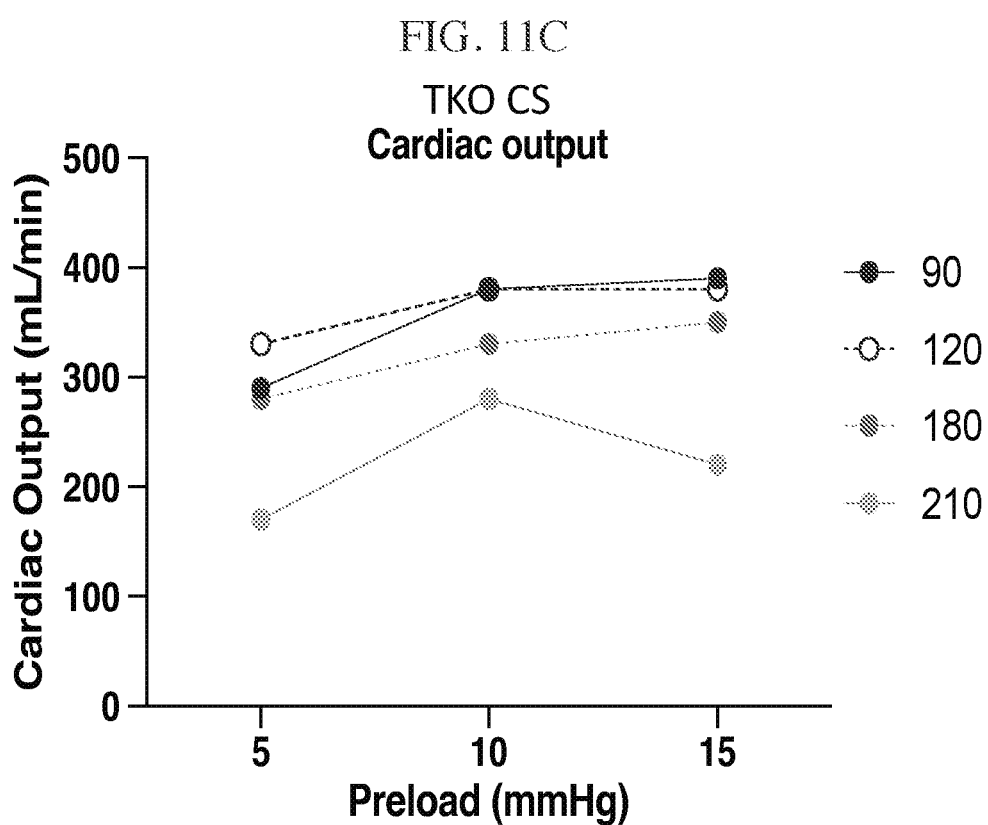

FIG. 11C is a graph showing cardiac output over time in TKO cardiac xenografts that are stored in a cold preservation solution (CS).

Figure 11D:
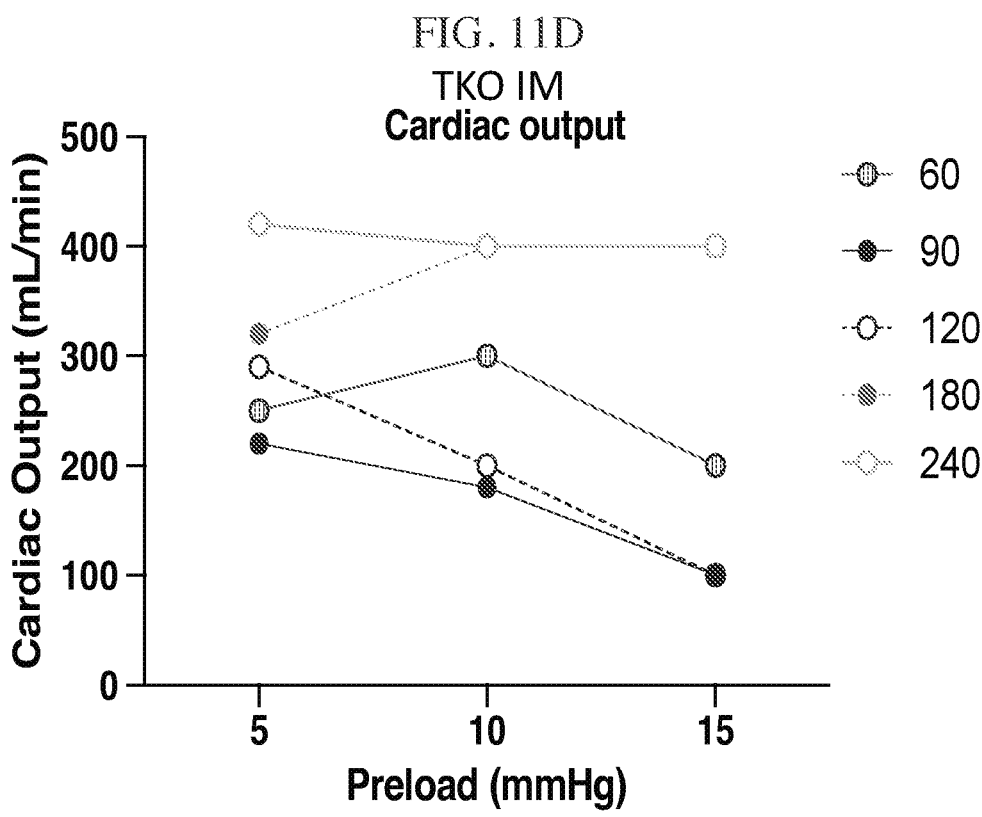

FIG. 11D is a graph showing cardiac output over time in TKO cardiac xenografts that are perfused with oxygenated Steen's solution with red blood cells (IM).

Figures 12A, 12B:
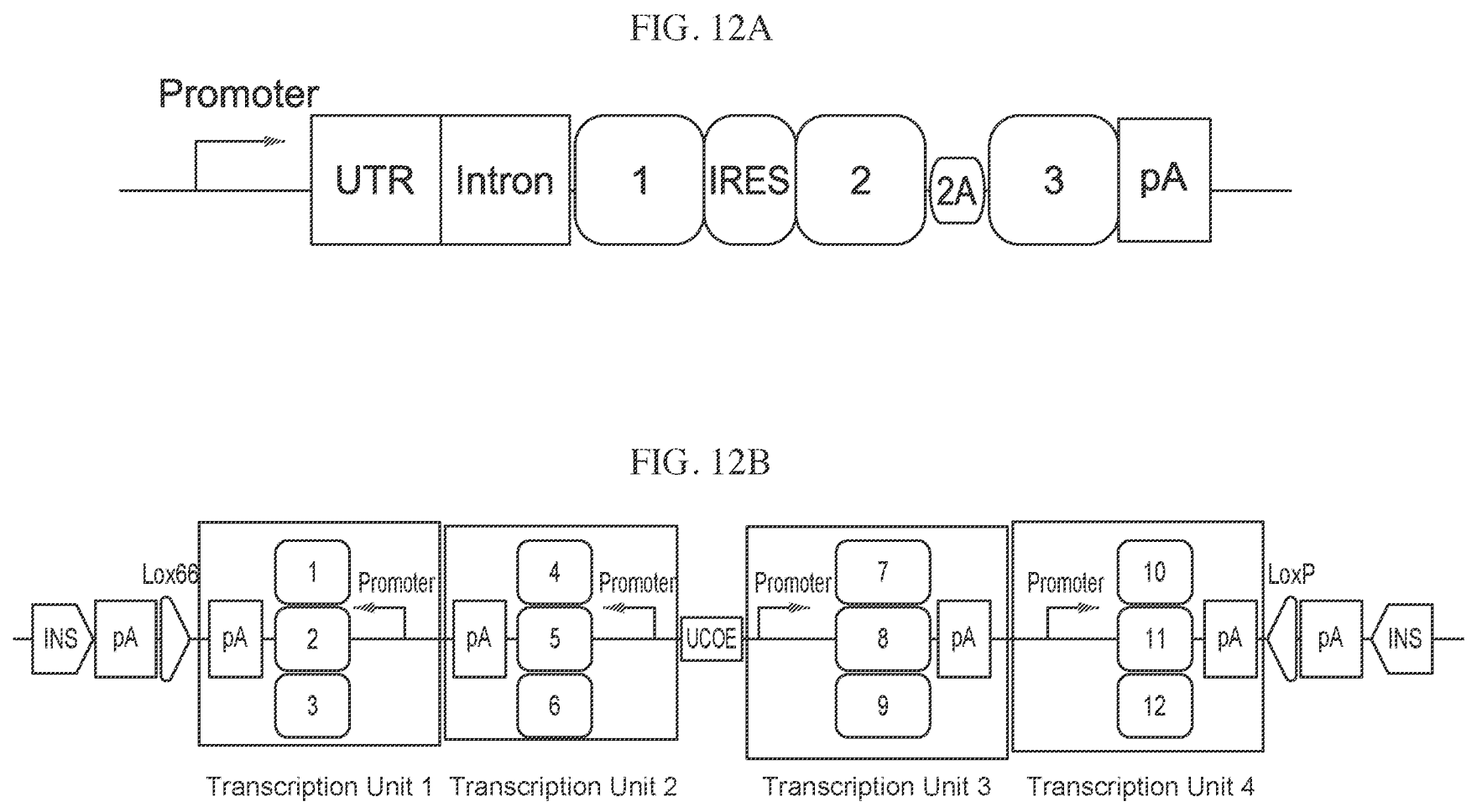

FIG. 12A is an exemplary polycistronic cassette comprising a poly A (pA) sequence, an untranslated region (UTR), an intron, an IRES, a 2A peptide, and three cistrons (labeled "1," "2," and "3."

FIG. 12B is an exemplary nucleic acid comprising multiple polycistronic cassettes (referred to as "transcription unit 1," "transcription unit 2," "transcription unit 3," and "transcription unit 4." Each transcription unit contains a promoter, a poly A (pA) sequence, and cistrons (labeled "1," "2," "3," "4," "5," "6," "7," "8," and "9.") The nucleic acid also comprises insulator sequences (labeled "INS"), a first loxP site (labeled "loxP"), and a second loxP site (labeled "lox66"). An ubiquitous chromatin opening element (UCOE) separates the second and third polycistronic cassettes.

Figure 13A:
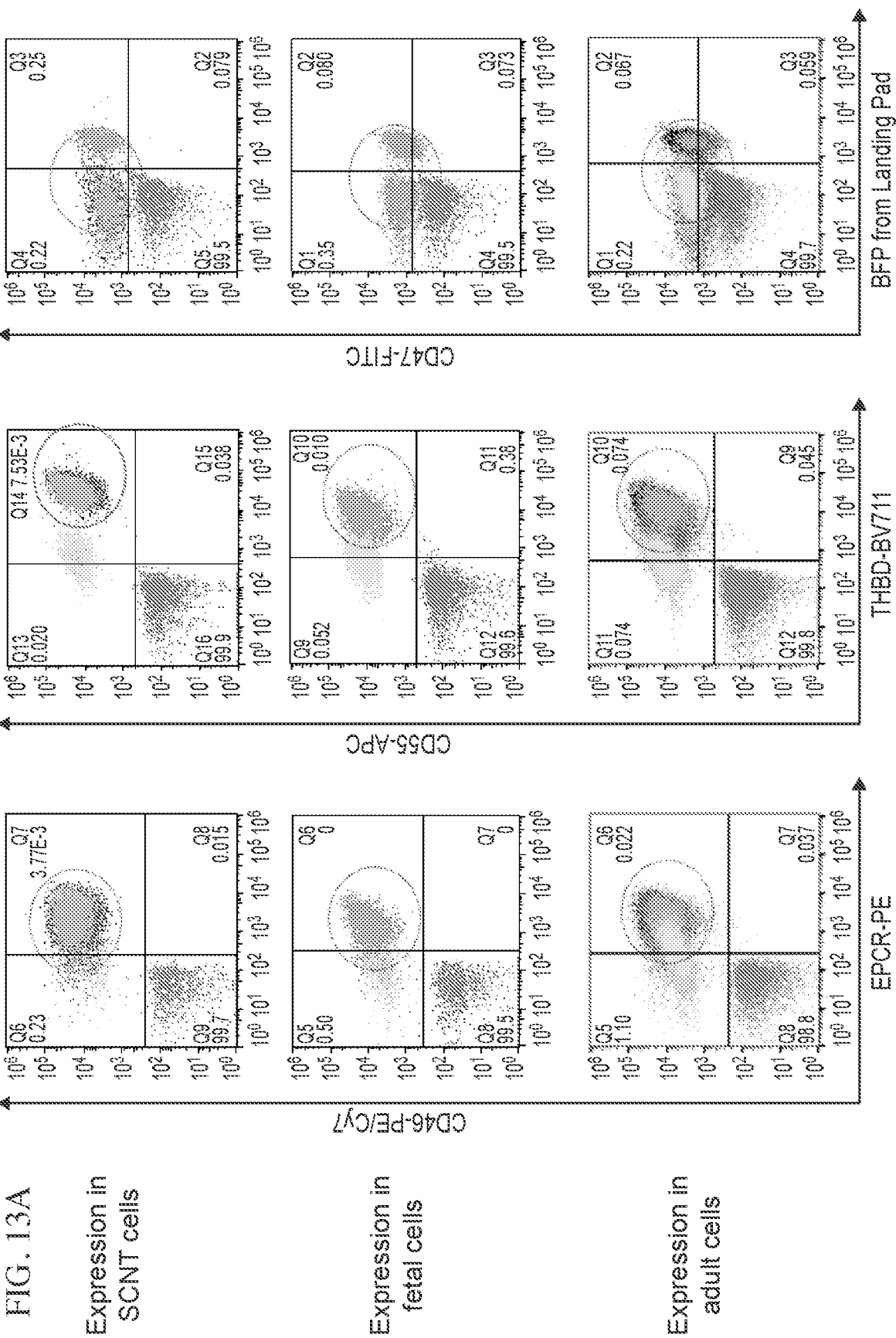
Figure 13B:
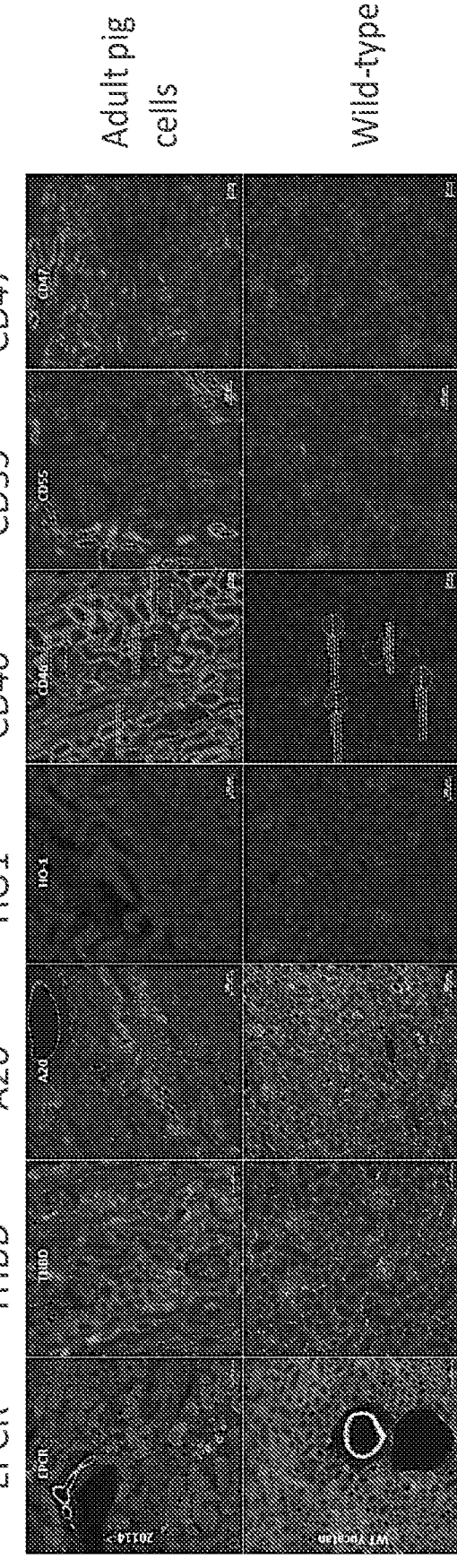

FIG. 13A shows expression of a nucleic acid comprising the polycistronic cassettes of FIG. 2D in donor cells, porcine fetal cells, and adult porcine cells via flow cytometry. The cells that are circled comprise the polycistronic cassettes of FIG. 2D. FIG. 13B shows expression of a nucleic acid comprising the polycistronic cassettes of FIG. 2D in donor cells, porcine fetal cells, and adult porcine cells via immunohistochemistry.

Figure 14:
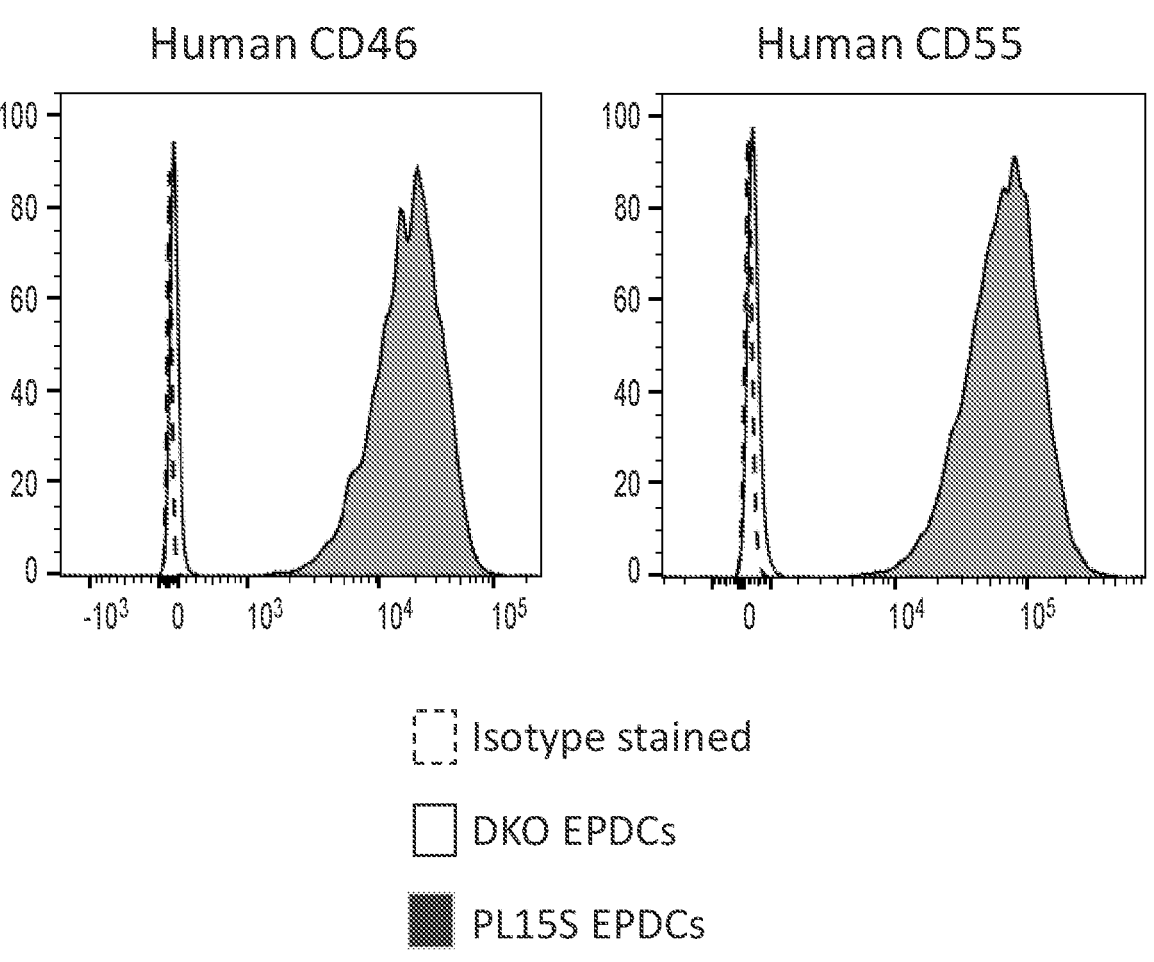

FIG. 14 shows that ear punch derived cells (EPDCs) comprising the polycistronic cassettes of FIG. 2D express CD46 and CD55.

Figure 15A:
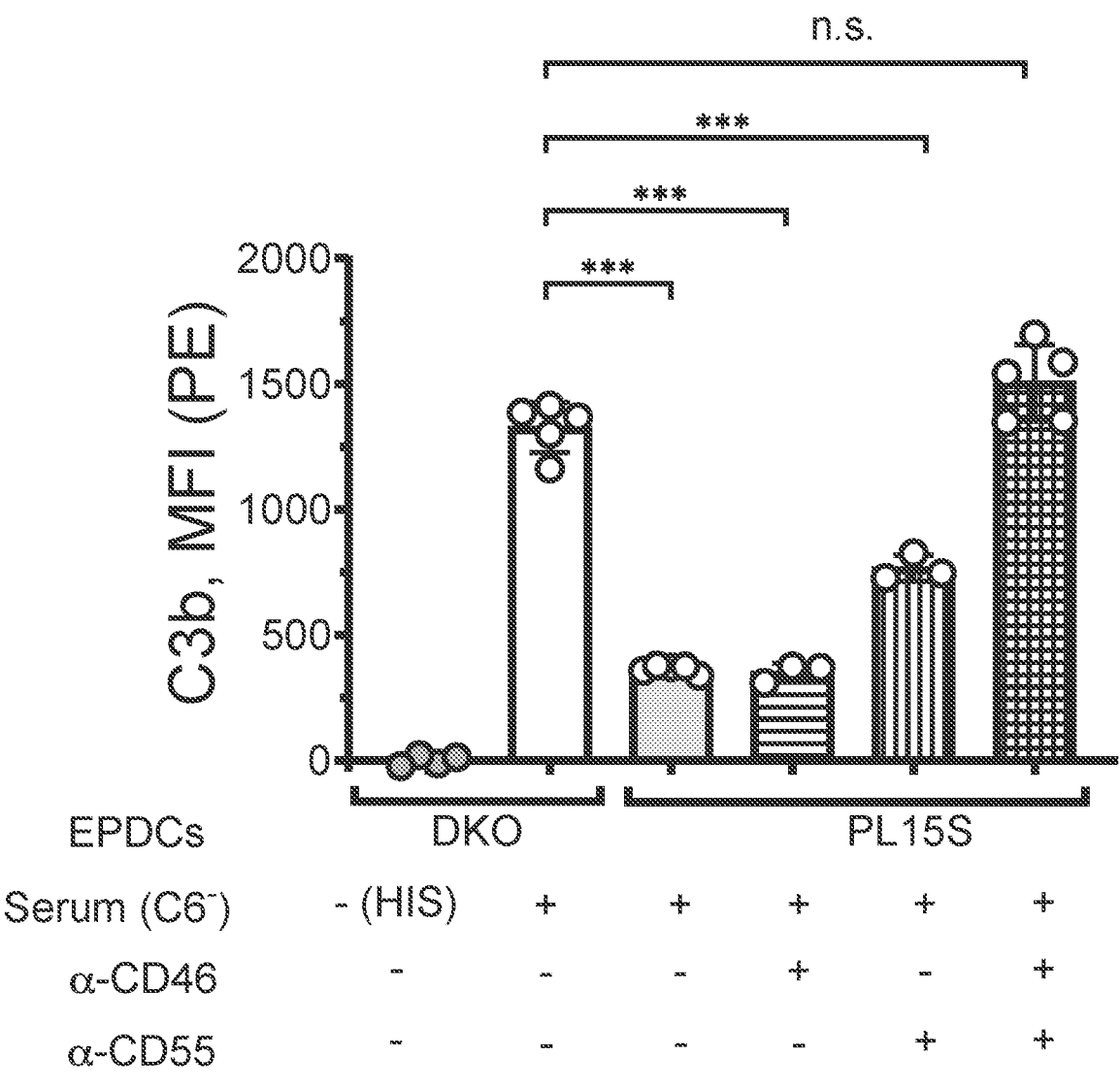
Figure 15B:
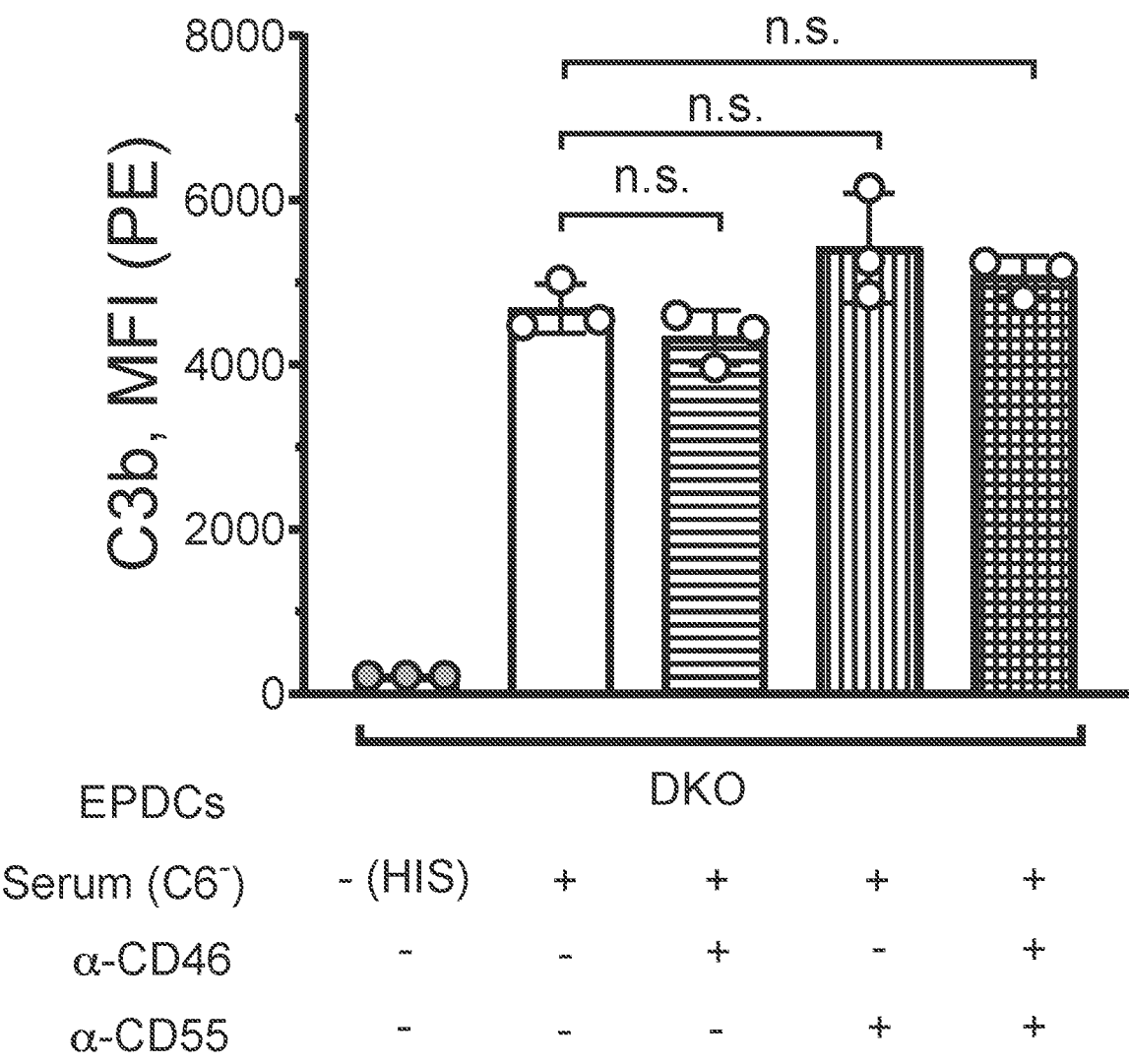

FIG. 15A shows surface protein expression of human CD46 and CD55 on ear punch derived cells (EPDCs) from PL15S pigs or from GGTA1 and B4GALNT2 double knockout (DKO) pigs as a control, or isotype control-stained cells. FIG. 15B assesses complement activation in PL15S pigs or in DKO pigs. PL15S pigs express the polycistronic cassettes of FIG. 2D.

Figure 16A:
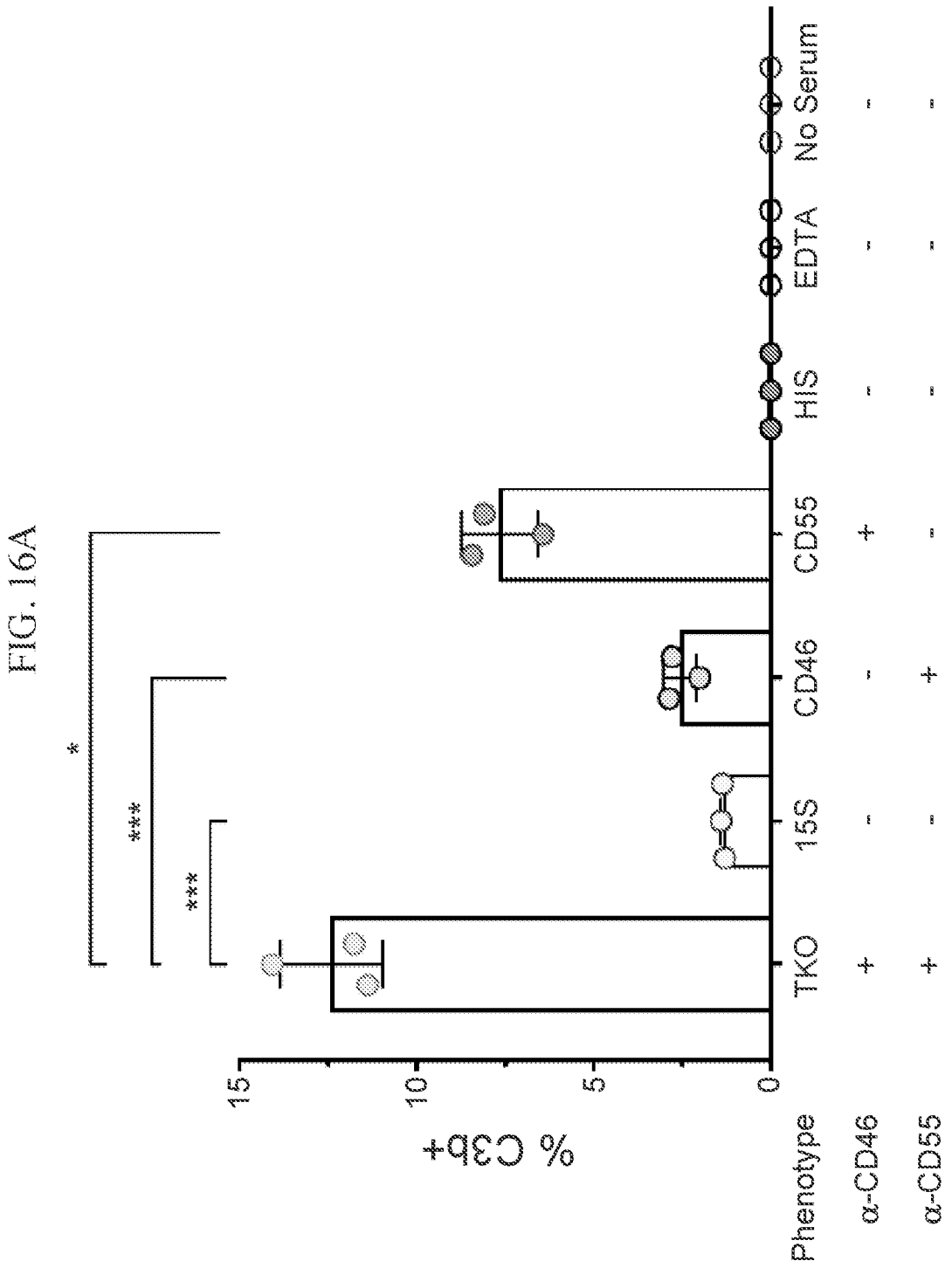

FIGS. 16A-C show that the nucleic acids described herein provide protection from complement deposition in islet cells. FIG. 16A shows that in the absence of anti-CD46 and/or anti-CD55 blocking antibodies, cells comprising a nucleic acid comprising the polycistronic cassettes of FIG.

2D provide protection from complement deposition in islet cells. In the absence of anti-CD46 and/or anti-CD55 blocking antibodies, cells comprising a nucleic acid comprising the polycistronic cassettes of FIG. 4D provide protection from complement deposition in islet cells, as demonstrated by a reduced percentage of C3b (FIG. 16C) and a reduced mean fluorescence intensity of C3b (FIG. 16B).

Figure 17B:
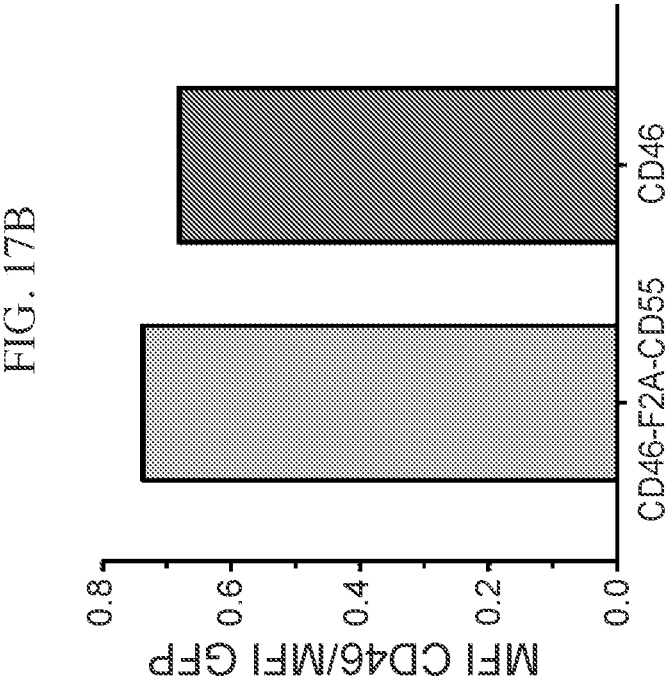
Figure 17A:
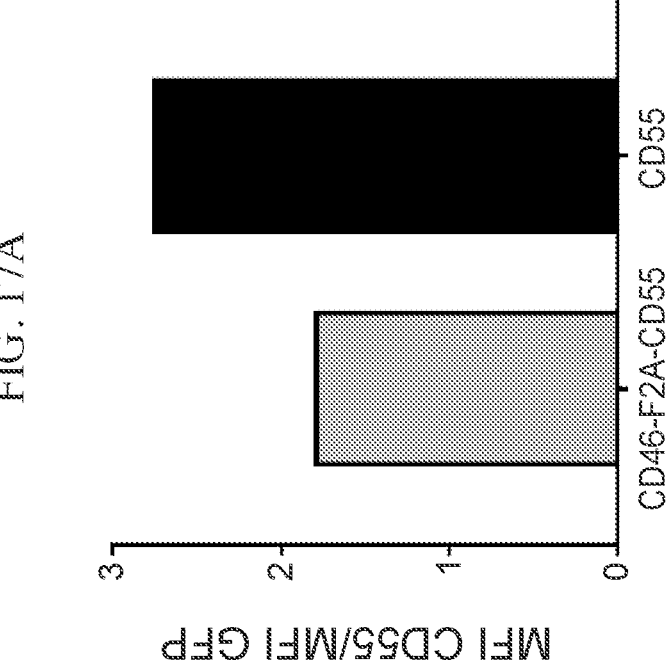
Figure 17C:
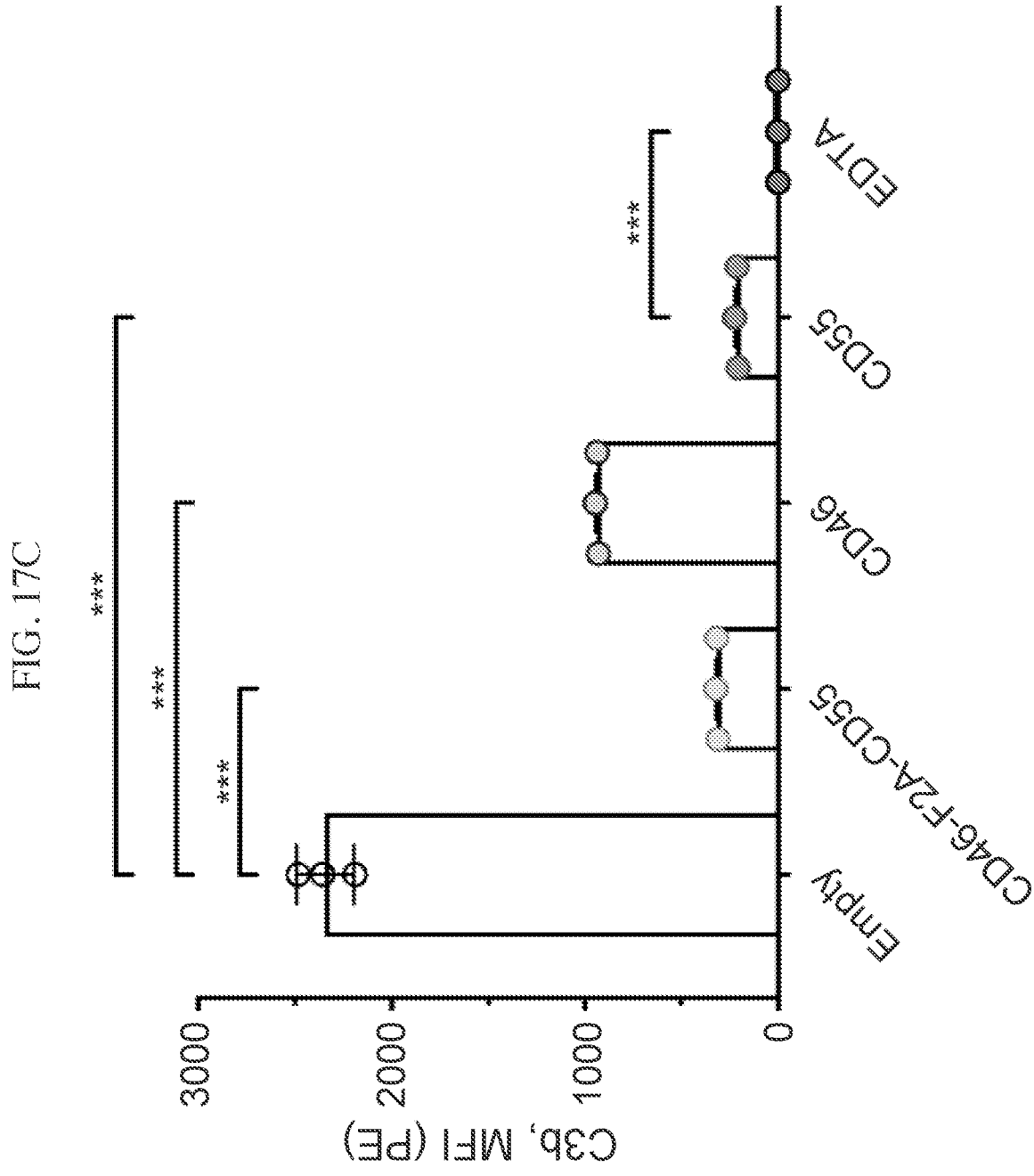

FIGS. 17A-B show expression of CD55 and CD46 in KCDC cells that were transfected with a nucleic acid comprising CD46da, a nucleic acid comprising CD55, or a nucleic acid comprising CD46da and CD55 linked by a F2A peptide. FIG. 17A shows that CD55 is expressed when linked to a 2A peptide. FIG. 17B shows that CD46da (labeled "CD46") is expressed when linked to a 2A peptide. FIG. 17C shows that a nucleic acid comprising CD46da ("CD46") and CD55 reduces complement deposition.

Figure 18A:
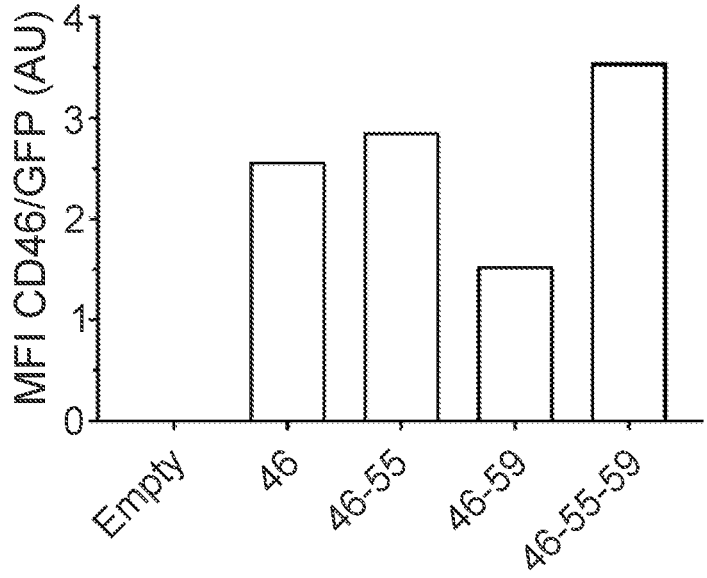
Figure 18B:
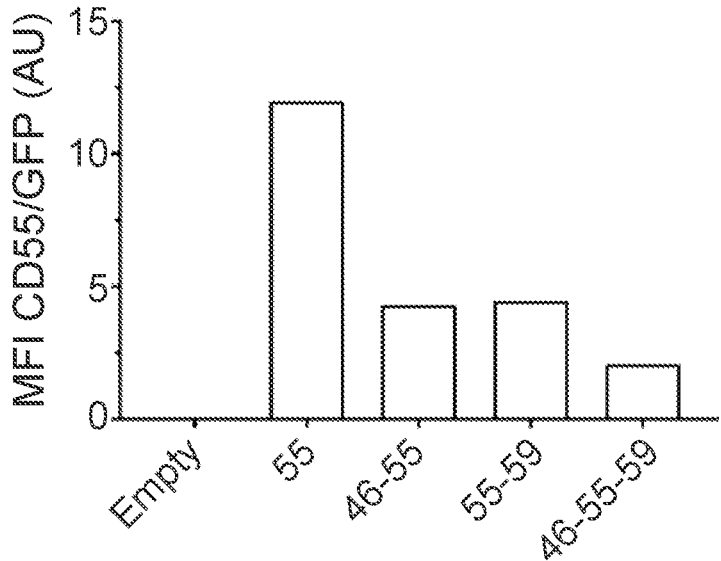
Figure 18C:
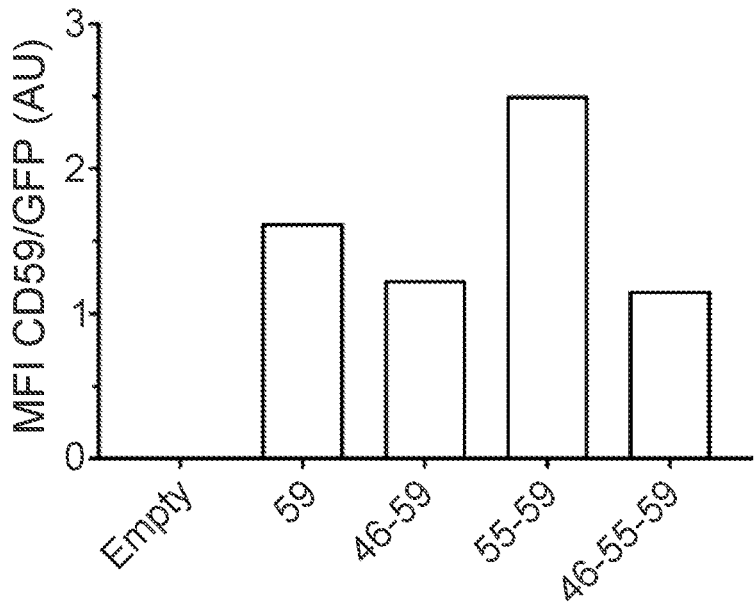
Figure 18D:
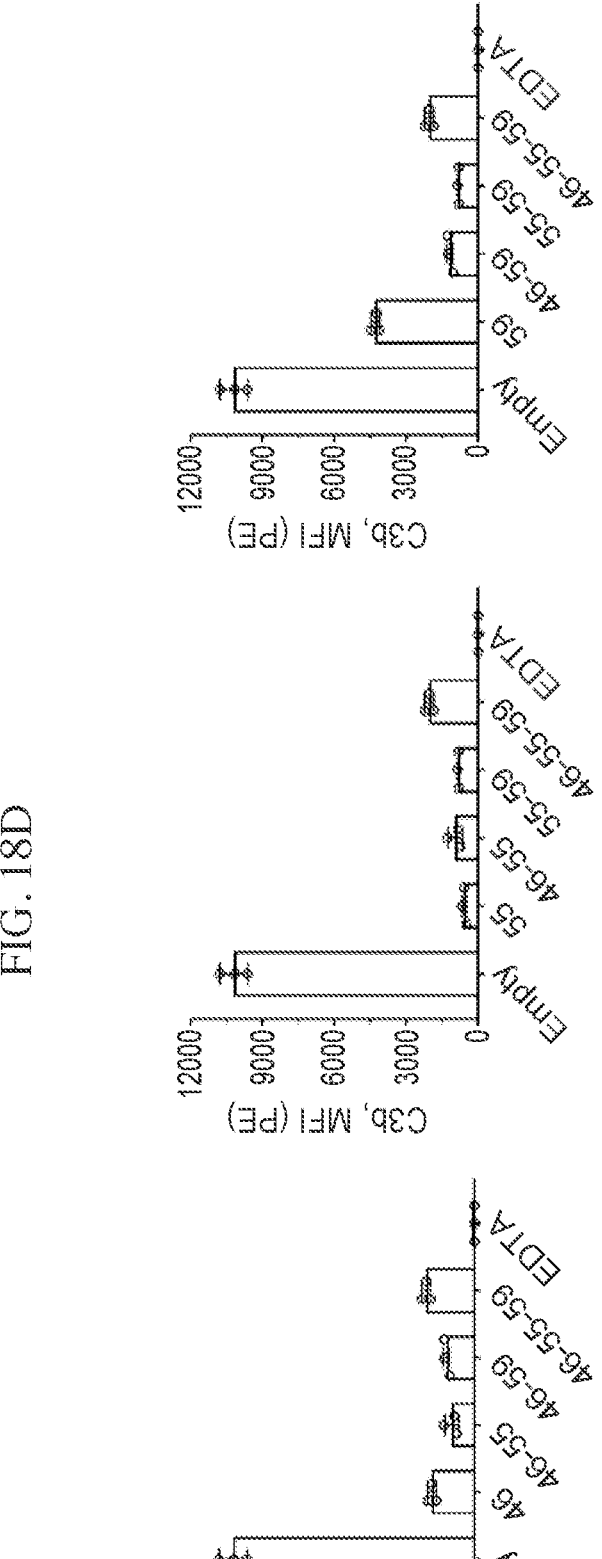

FIGS. 18A-C show expression of CD46, CD55, and CD59 in KCDC cells transfected with one of the following nucleic acids: (i) hsCD46da2; (ii) hsCD55; (iii) hsCD59; (iv) hsCD46da2-F2A-hsCD55; (v) hsCD46da2-F2A-hsCD59; (vi) hsCD55-P2A-hsCD59; or (viii) hsCD46da2-F2A-hsCD55-P2A-hsCD59. FIGS. 18A-C show that CD46 (FIG. 18A), CD55 (FIG. 18B), and CD59 (FIG. 18C) each express. FIG. 18D shows that expression of each of these nucleic acids reduces complement deposition. In each of FIGS. 18A-D, CD46da2 is labeled "46," CD55 is labeled "55," and CD59 is labeled "59."

Figure 19A:
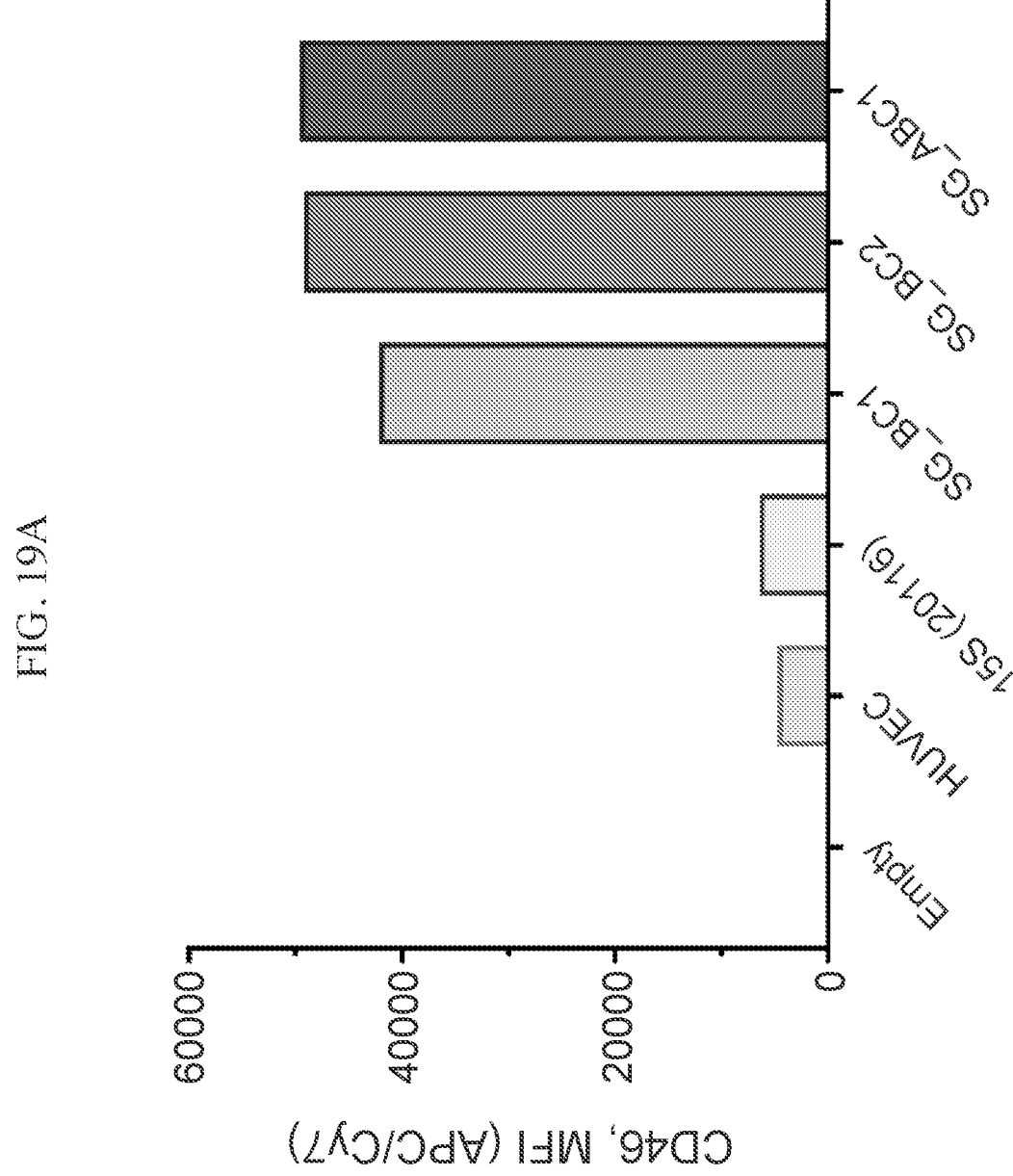

FIG. 19A shows expression of the CD46 isoforms BC-Cyt1 ("SG_BC1"), Bc-Cy2 ("SG_BC2"), and ABC1 ("SG_ABC1"). FIG. 19B shows the ability of each of the CD46 isoforms BC-Cyt1 ("SG_BC1"), Bc-Cy2 ("SG_BC2"), and ABC1 ("SG_ABC1") to reduce complement deposition. Expression of a nucleic acid comprising the polycistronic cassettes of FIG. 2D also reduces complement deposition.

Figure 20A:
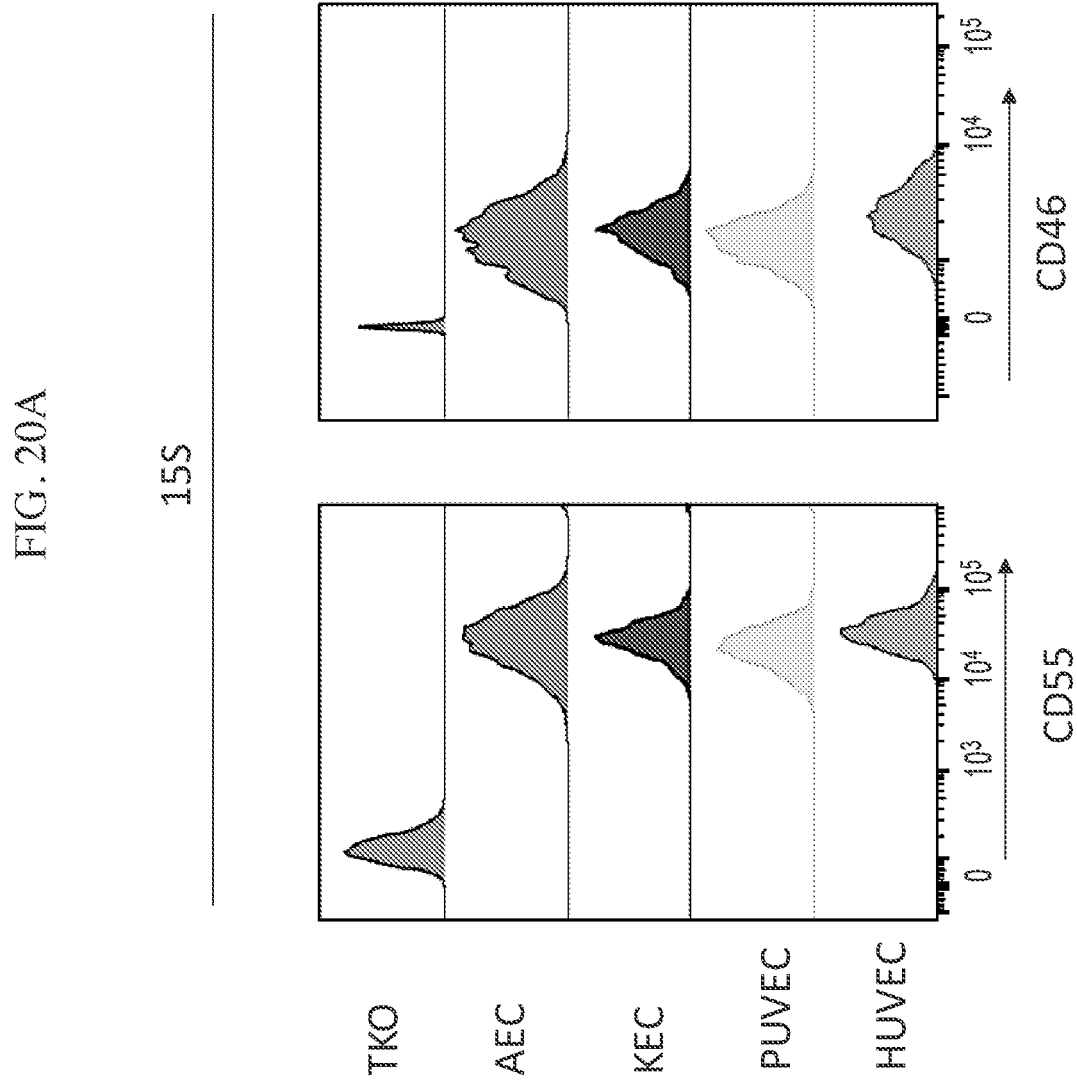
Figure 20B:
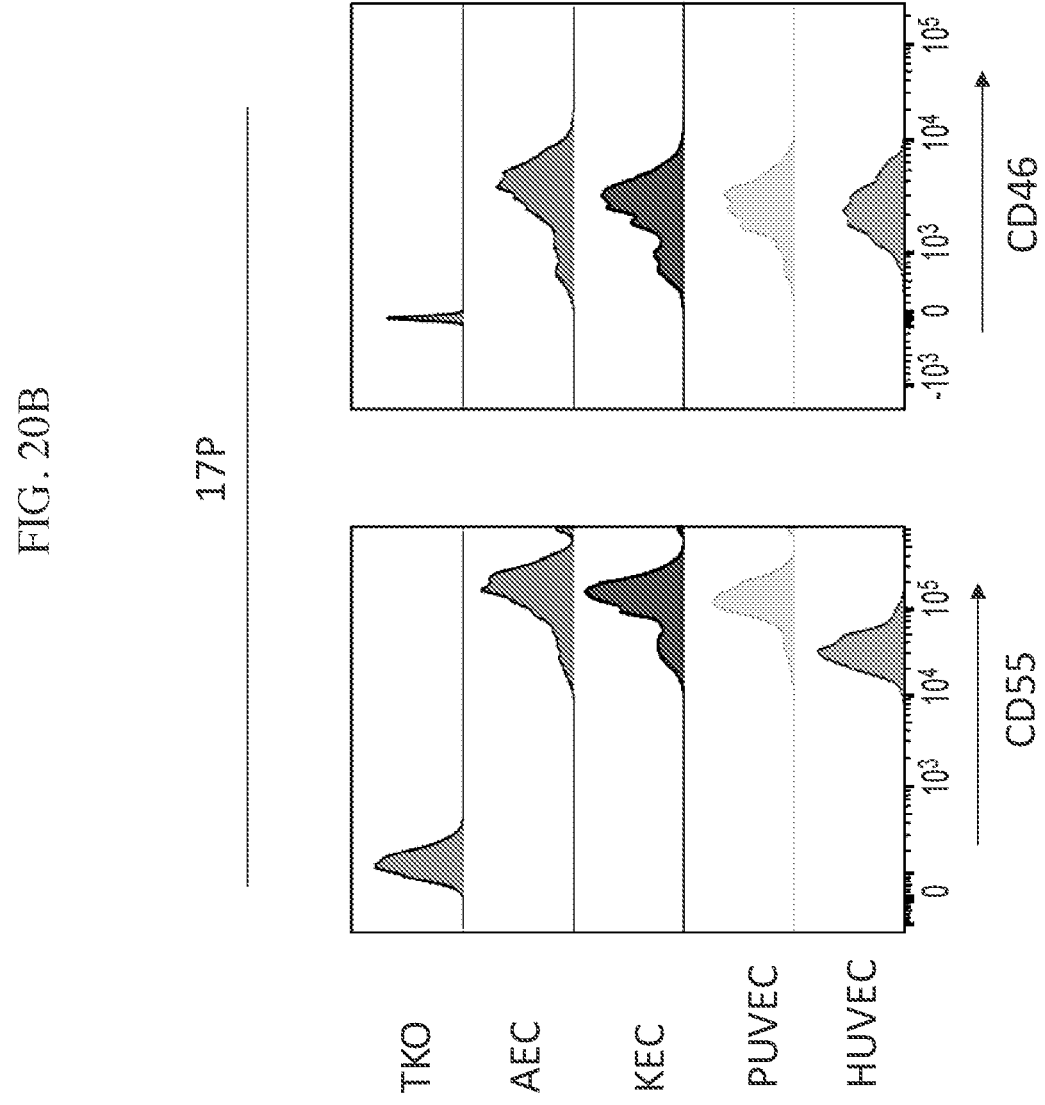
Figure 20C:
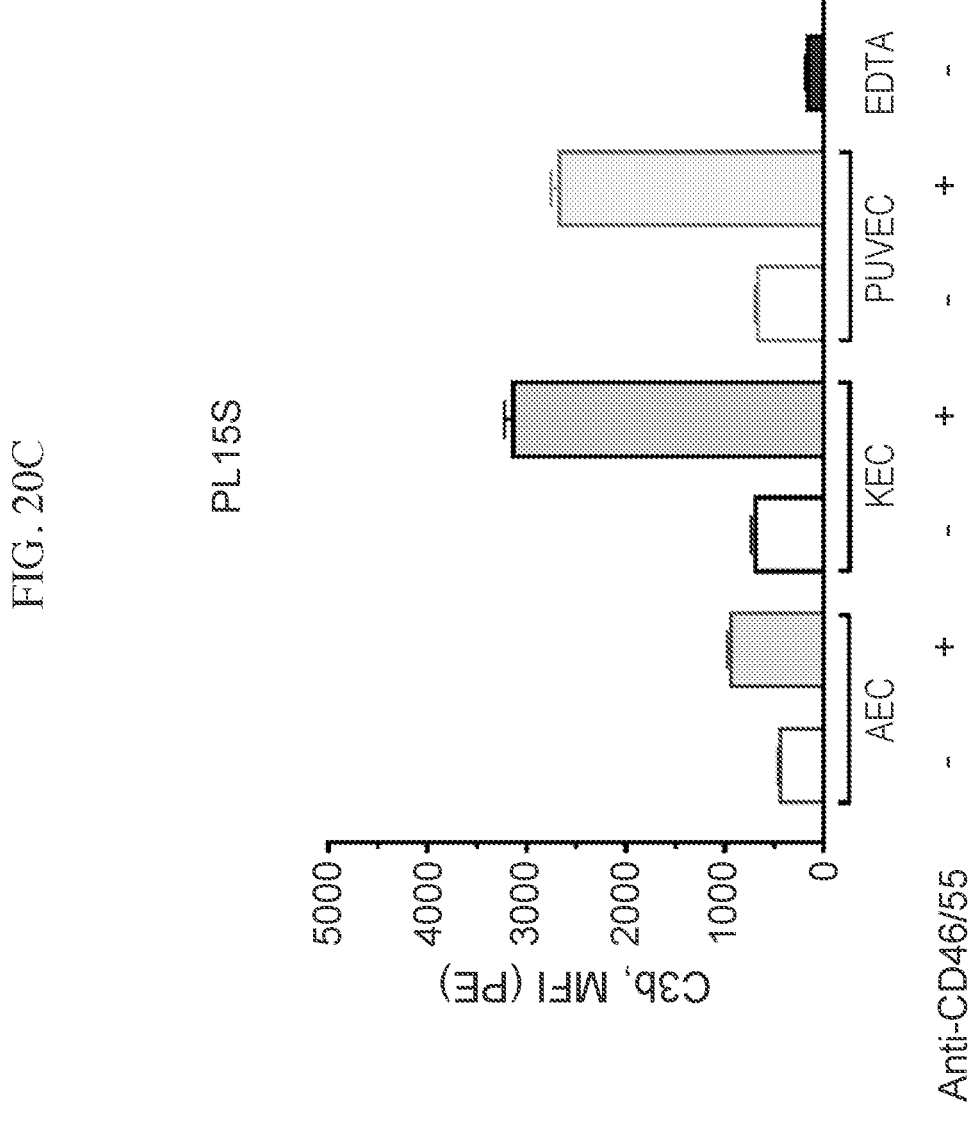
Figure 20D:
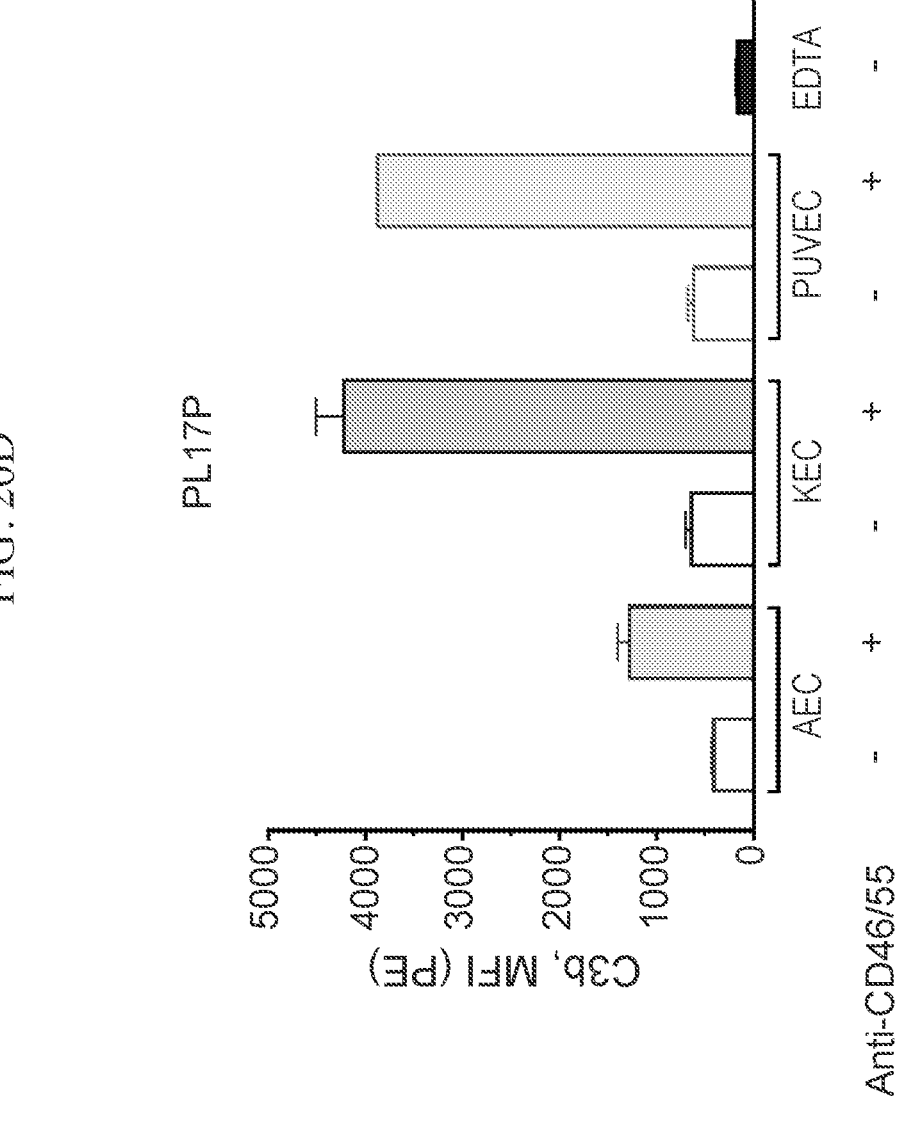

FIG. 20A shows that AEC, KEC, PUVEC, and HUVEC cells transfected with a nucleic acid comprising the polycistronic cassettes of FIG. 2D express CD46 and CD55 (FIG. 20A). FIG. 20B shows that AEC, KEC, PUVEC, and HUVEC cells transfected with a nucleic acid comprising the polycistronic cassettes of FIG. 4C express CD46 and CD55 (FIG. 20B). FIG. 20C shows that AEC, KEC, and PUVEC cells comprising a nucleic acid comprising the polycistronic cassettes of FIG. 2D reduce complement deposition in AEC, KEC, and PUVEC cells. FIG. 20D shows that AEC, KEC, and PUVEC cells comprising a nucleic acid comprising the polycistronic cassettes of FIG. 4C reduce complement deposition in AEC, KEC, and PUVEC cells.

Figure 21:
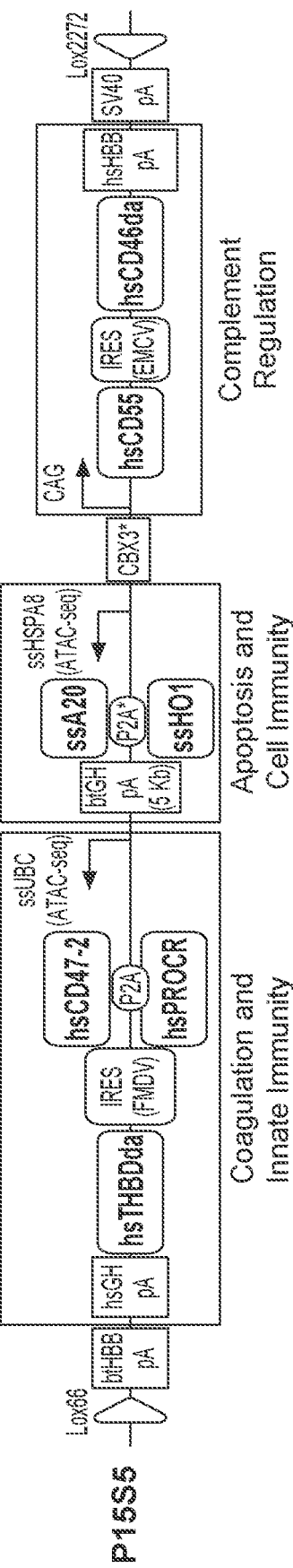
Figure 21A:
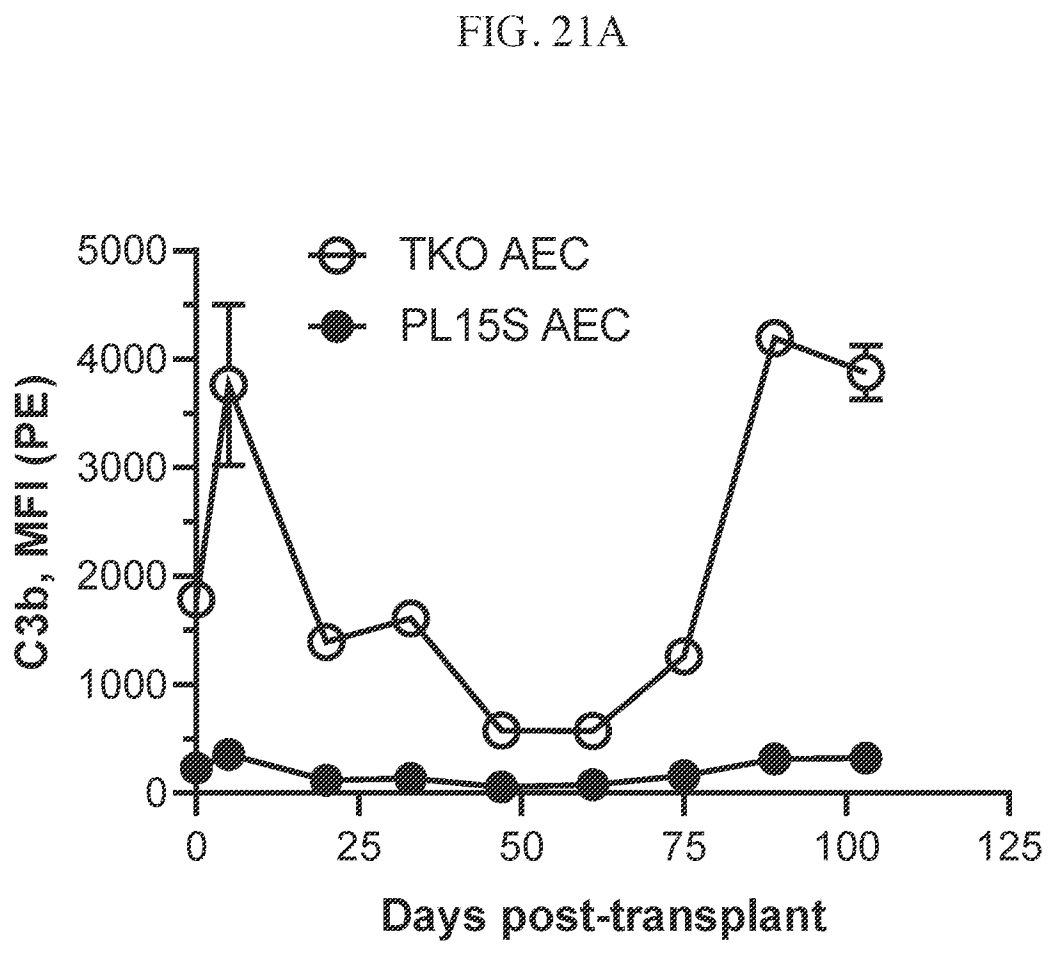
Figure 21B:
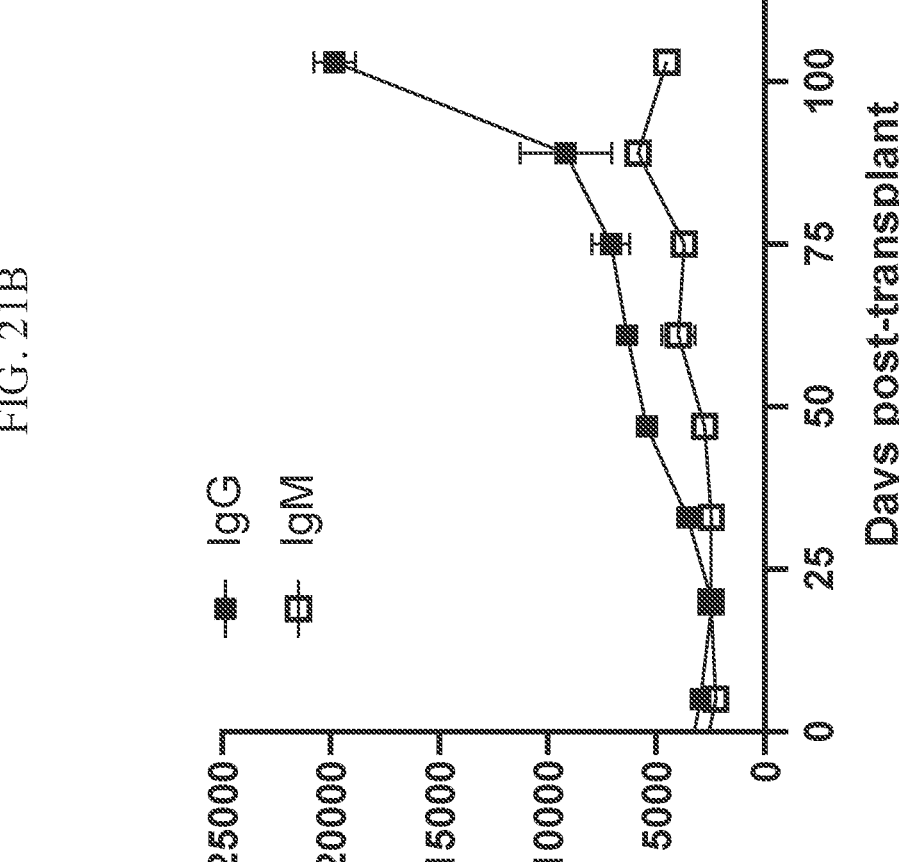

FIG. 21A shows that the expression of a nucleic acid containing the polycistronic cassettes of FIG. 2D ("15S") reduces complement deposition even in the presence of donor-specific alloantibodies (DSA). FIG. 21B shows the concentration of DSA after transplant. "POD" refers to days post transplant.

Figure 22:
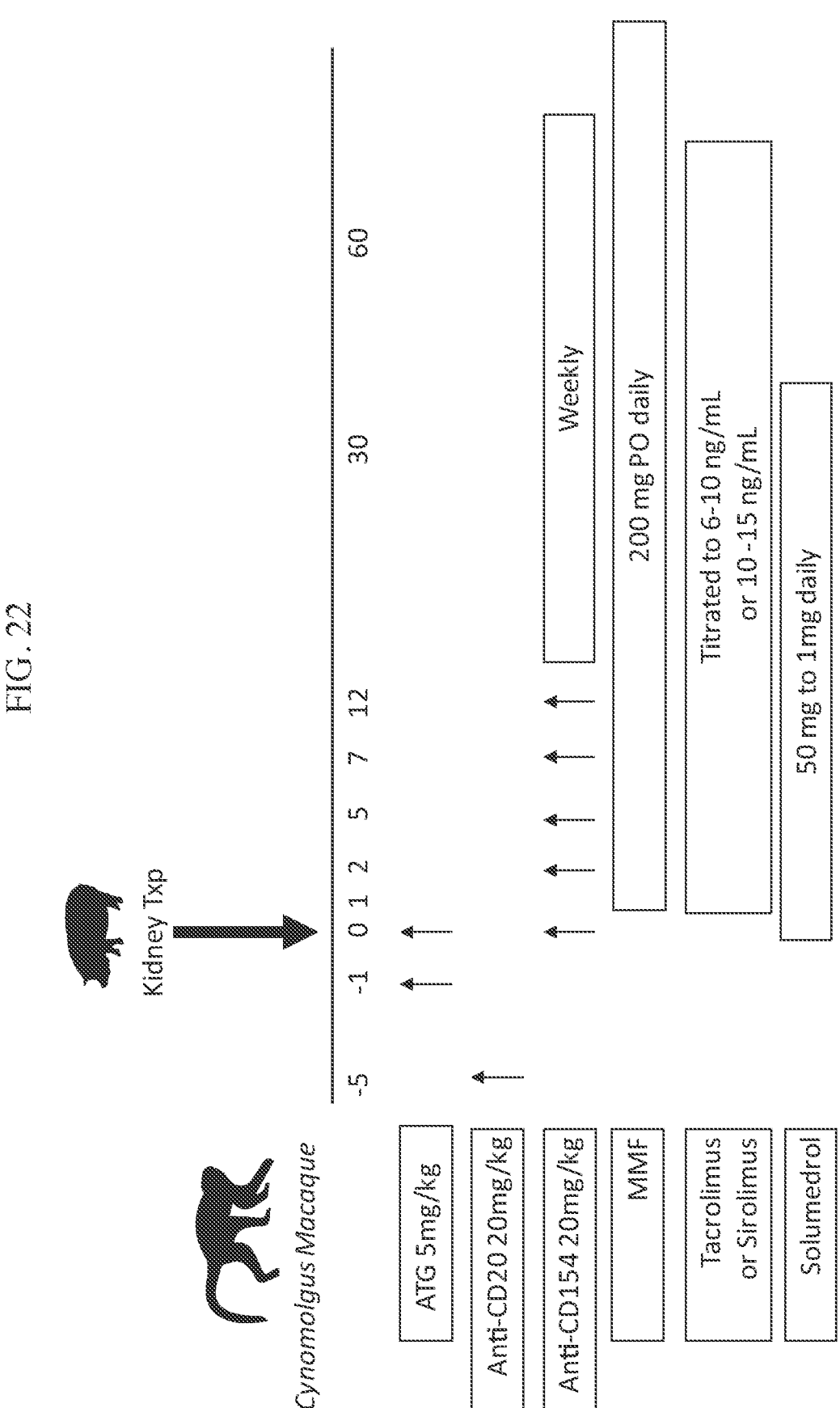

FIG. 22 shows the timeline of the experiments of Example 1.

Figure 23:
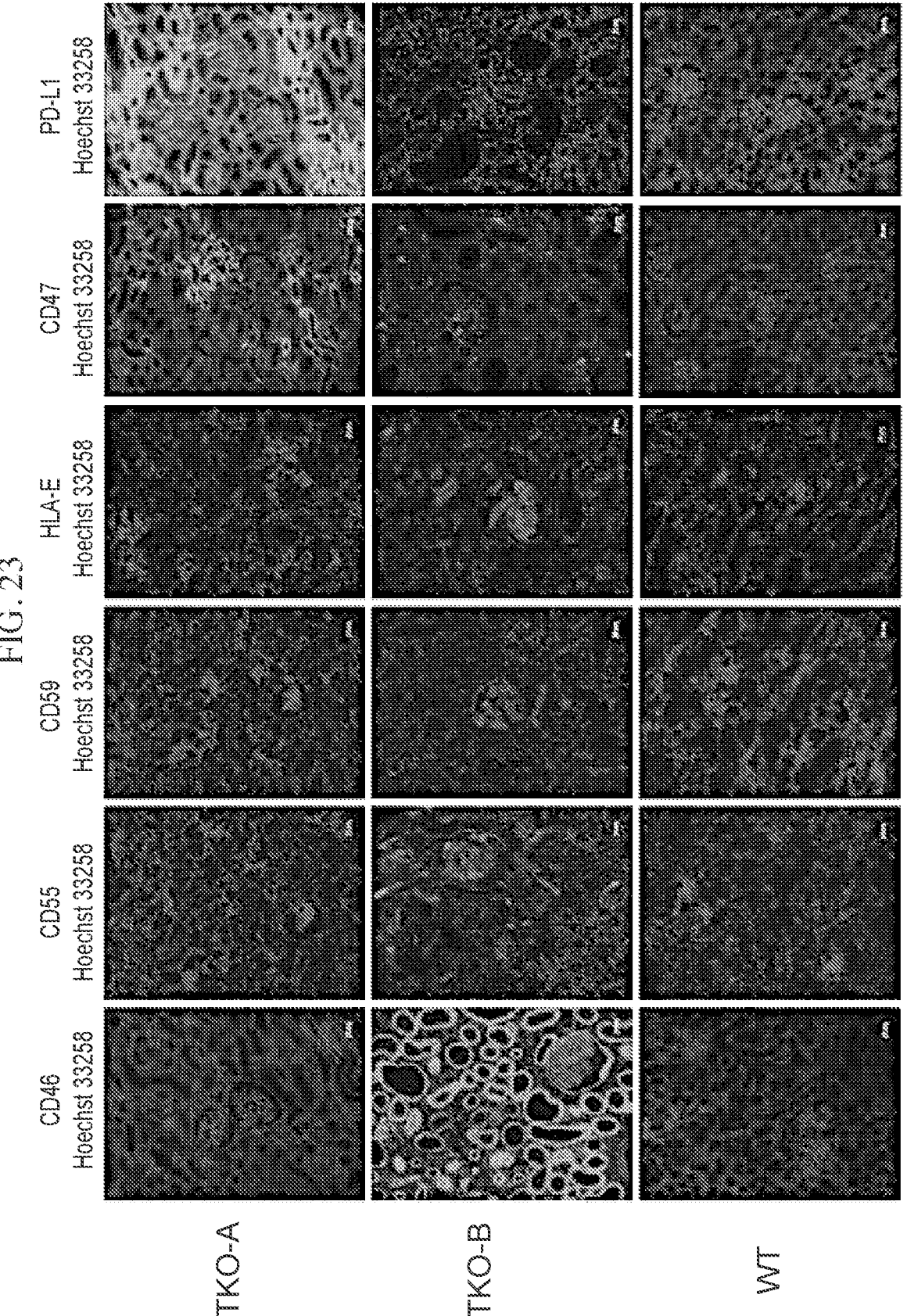

FIG. 23 shows images of CD46, CD55, CD59, HLA-E, CD47, and PD-L1 expression in TKO-A and TKO-B xenografts compared to wild-type xenografts in the animals of Example 1A.

Figure 24:
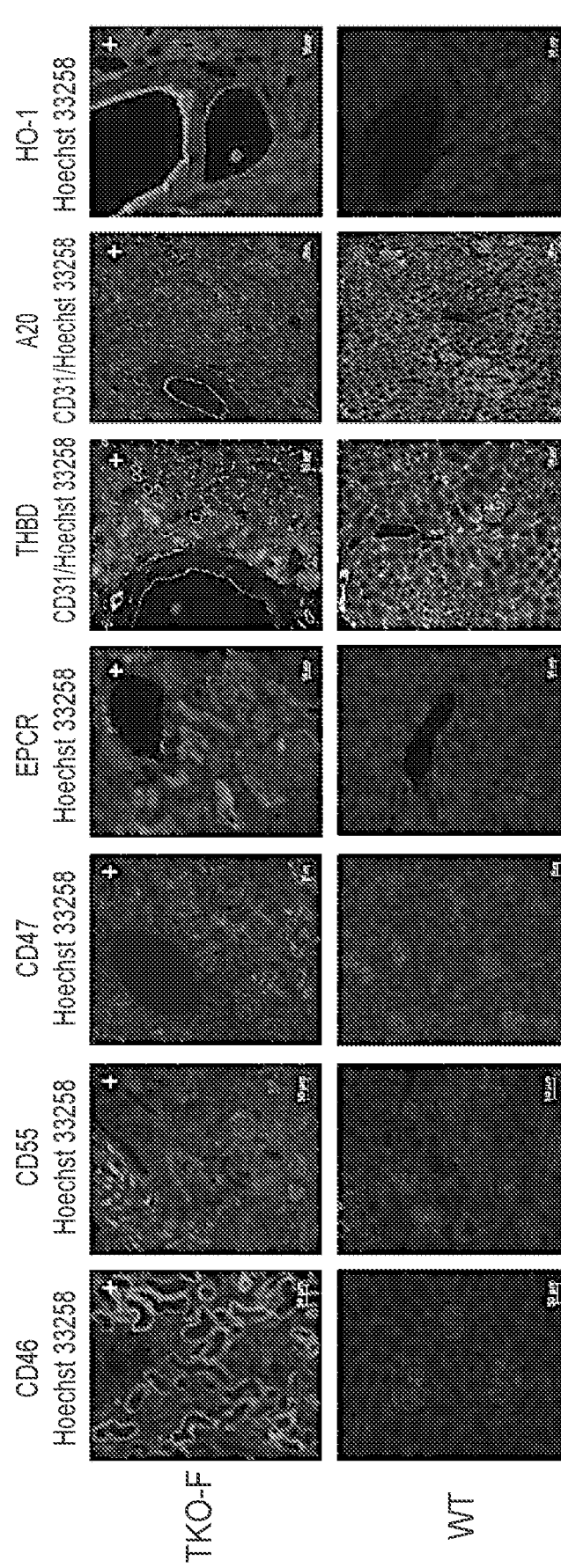

FIG. 24 shows images of CD46, CD55, CD47, EPCR, THBD, A20, and HO1 expression in the TKO-C animals of Example 1A.

Figure 25:
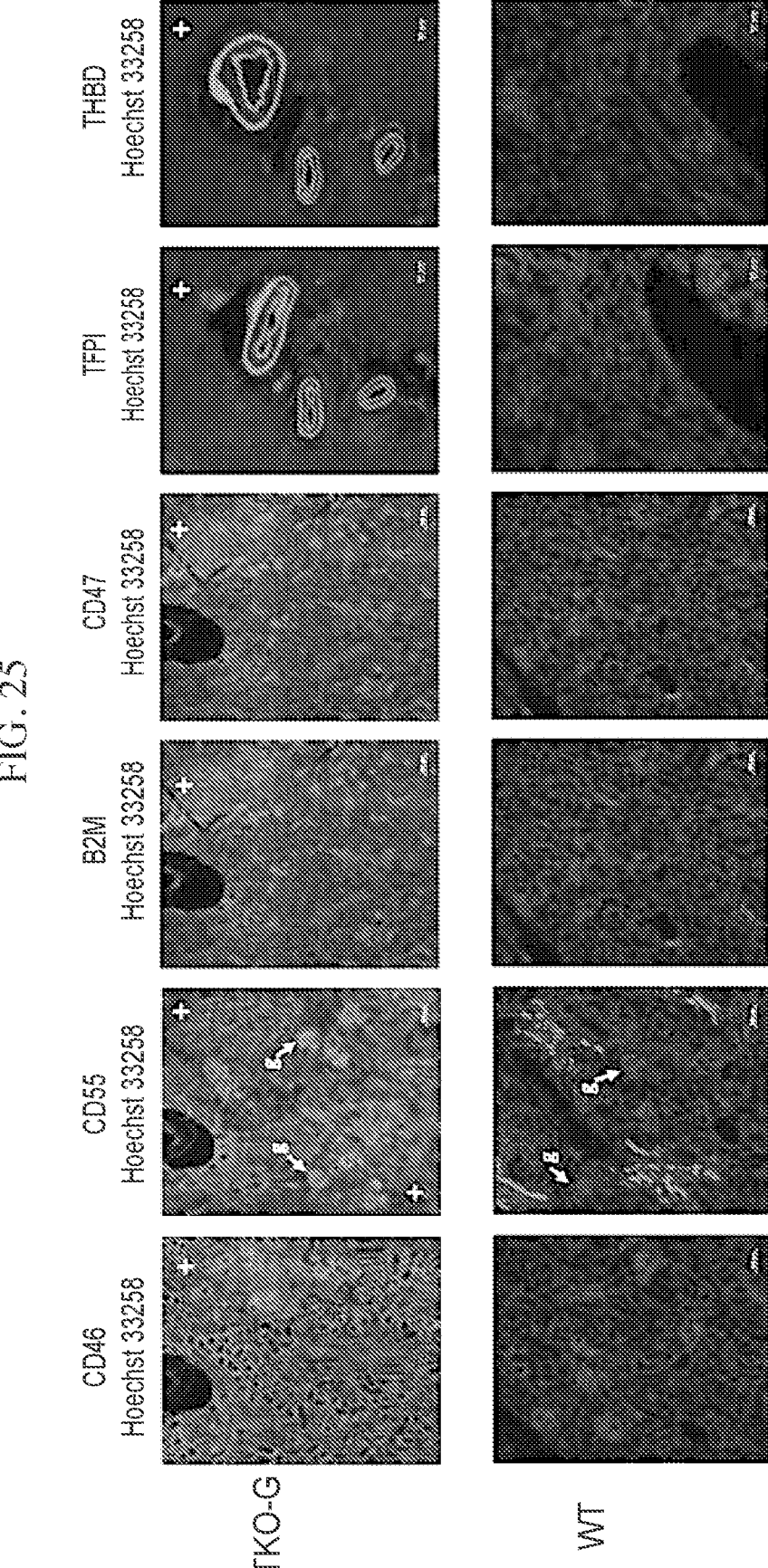

FIG. 25 shows images of CD46, CD55, B2M, CD47, TFPI, and THBD expression in the TKO-D animals of Example 1A.

FIG. 26 shows the concentration of creatinine (labeled Cr) in serum up to 313 days after transplant in the animals of Example 1A.

Figure 27:
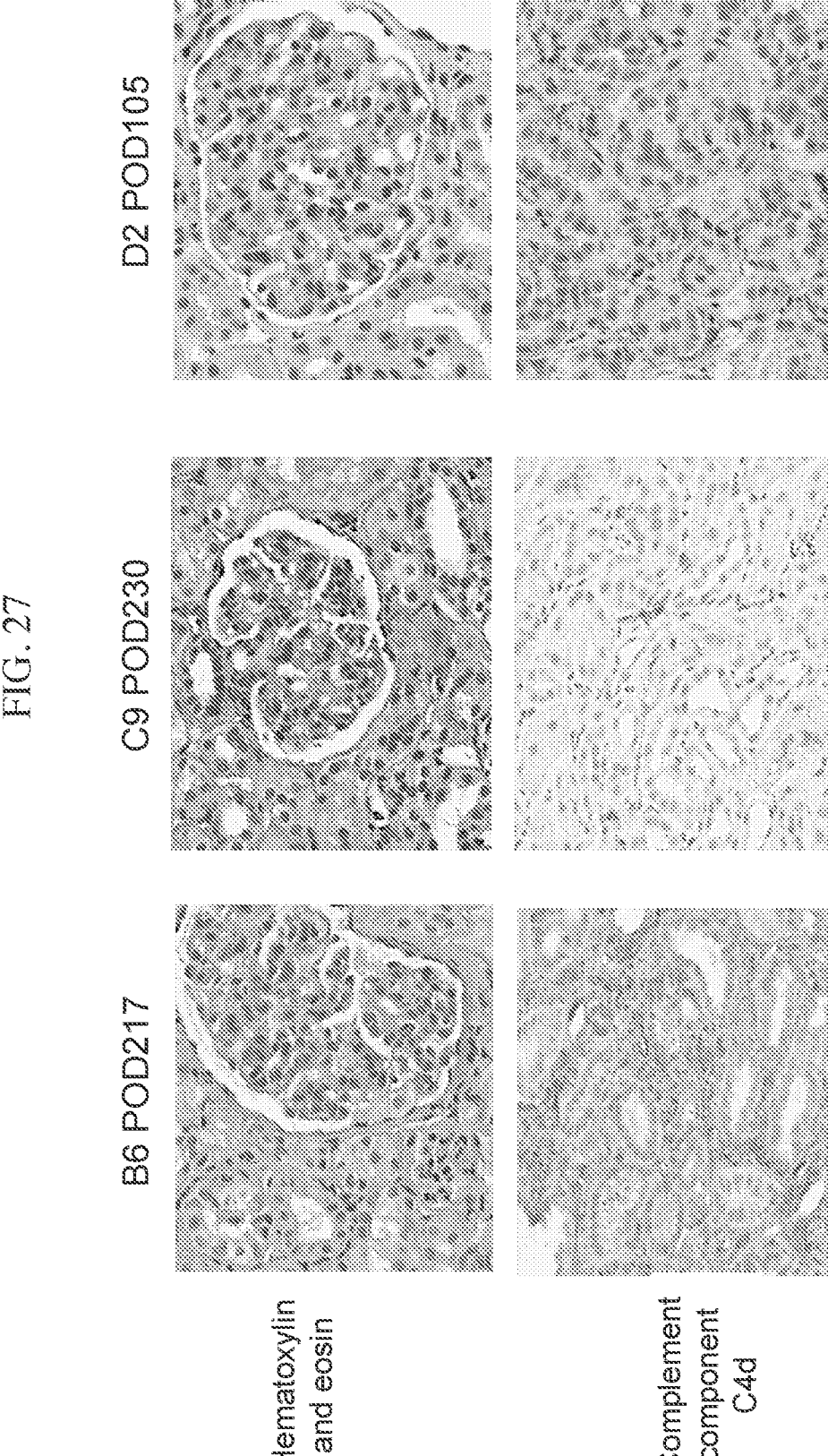
Figure 29A:
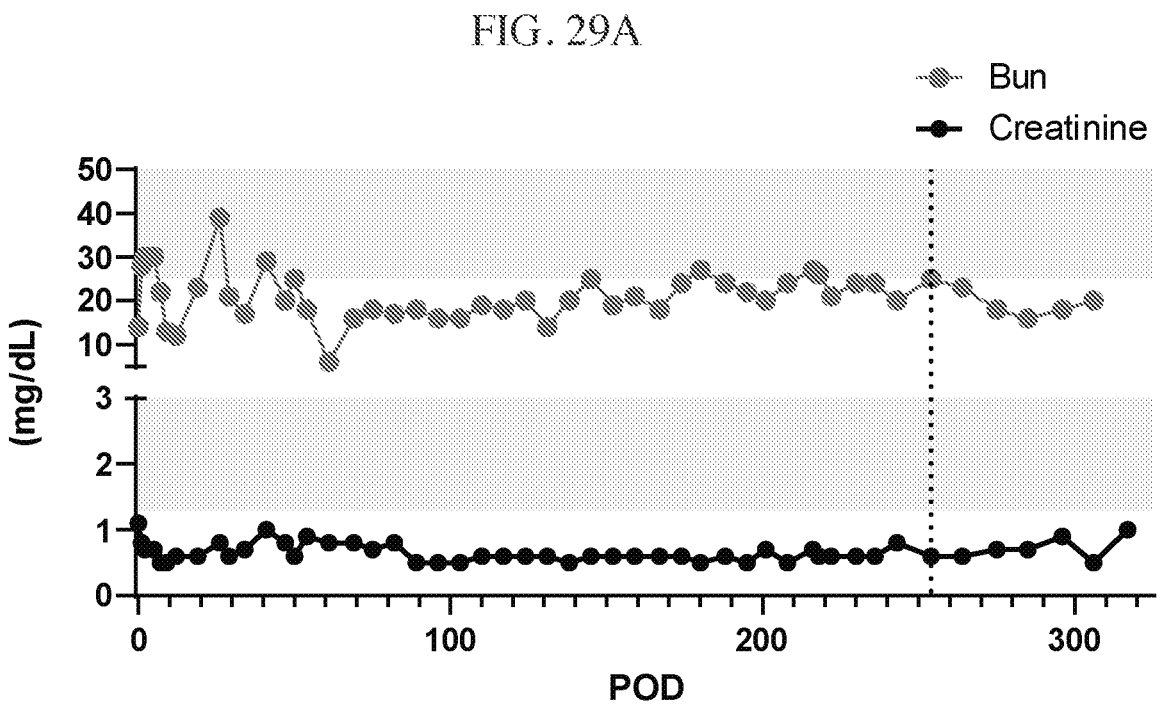
Figure 29B:
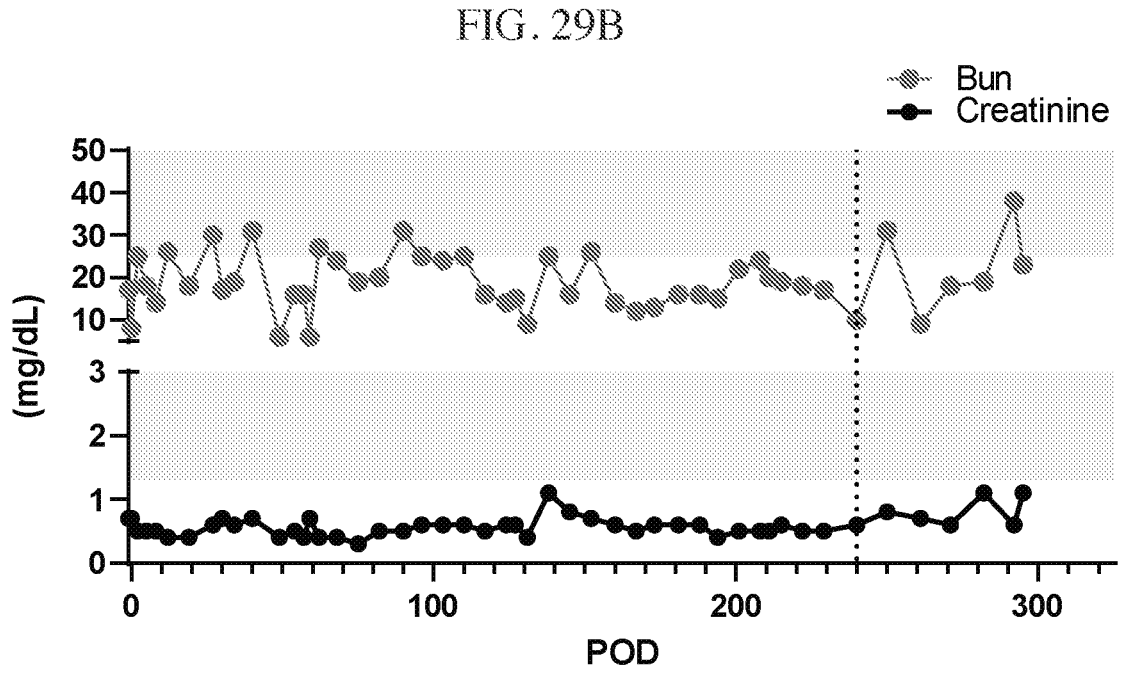
Figure 29C:
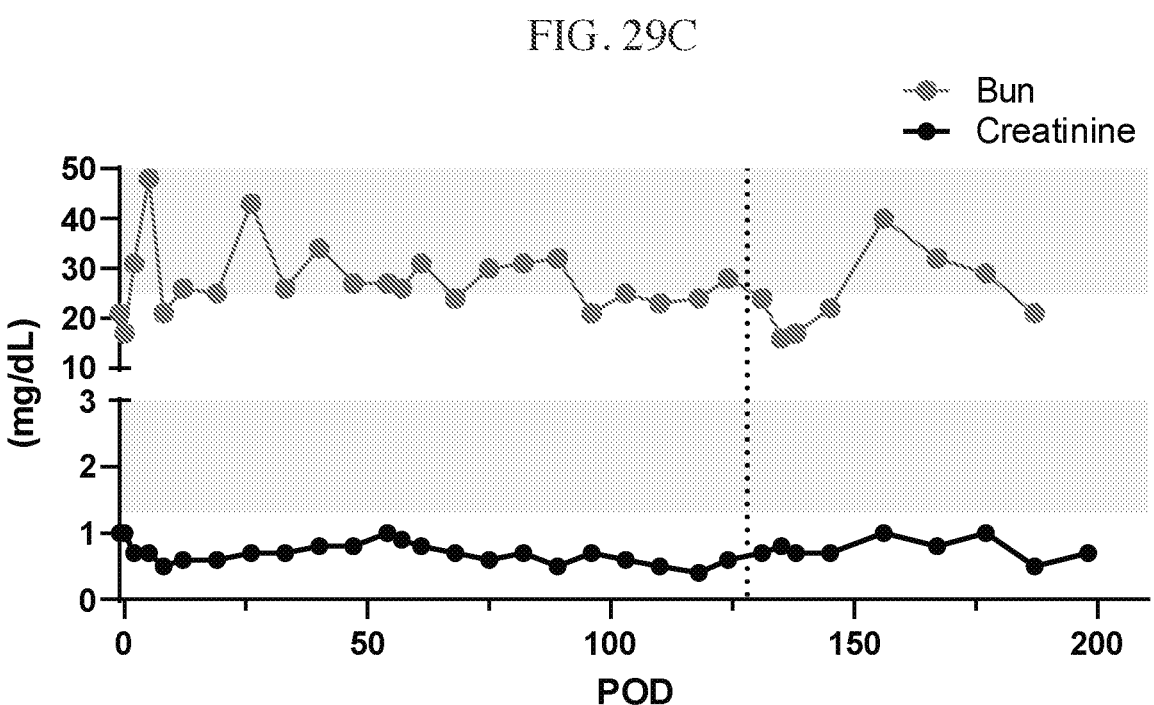
Figure 29D:
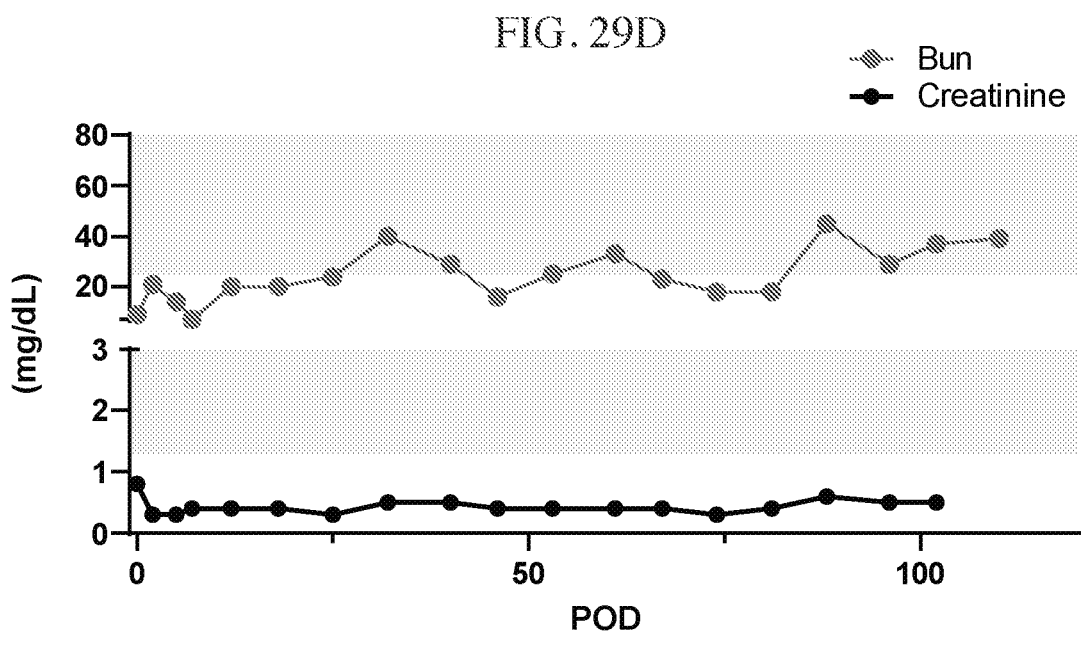
Figure 29E:
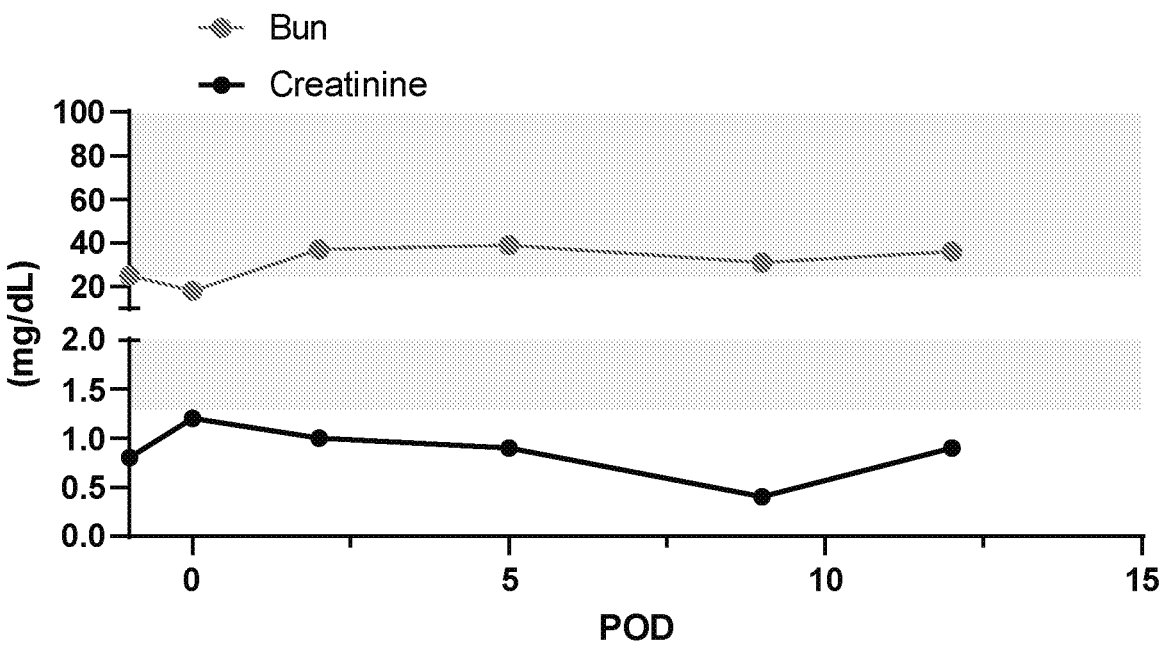

FIG. 27 shows images of kidney tissue stained with either hematoxylin and eosin or complement component C4d 217 ("POD217"), 230 ("POD230"), or 105 ("POD105") days after transplant. Animal B6 received a TKO-B xenograft. Animal C9 received a TKO-F xenograft. Animal D2 received a TKO-G xenograft.

FIG. 28A shows an exemplary landing pad. The landing pad comprises an insulator sequence (HS4), loxP sites (lox71 and lox2272), poly A sequences (SPAAct1 pA and hsHBB pA), a CAG promoter, and a marker gene (d2BFP). FIG. 28B shows incorporation of the 1555 payload of FIG. 2I at the genomic safe harbor locus. FIG. 28C shows an exemplary landing pad. The landing pad comprises loxP sites (loxP and lox 2272), an hsEF1α1, a poly A sequence (SPAC2 pA), and a blue fluorescent protein (BFP). The landing pad is integrated between exons 1 and exon 2 at an AAVS1 genomic safe harbor.

FIGS. 29A-E are graphs showing blood urea nitrogen (BUN) and creatinine for five monkeys comprising TKO-F xenografts.

Figure 30A:
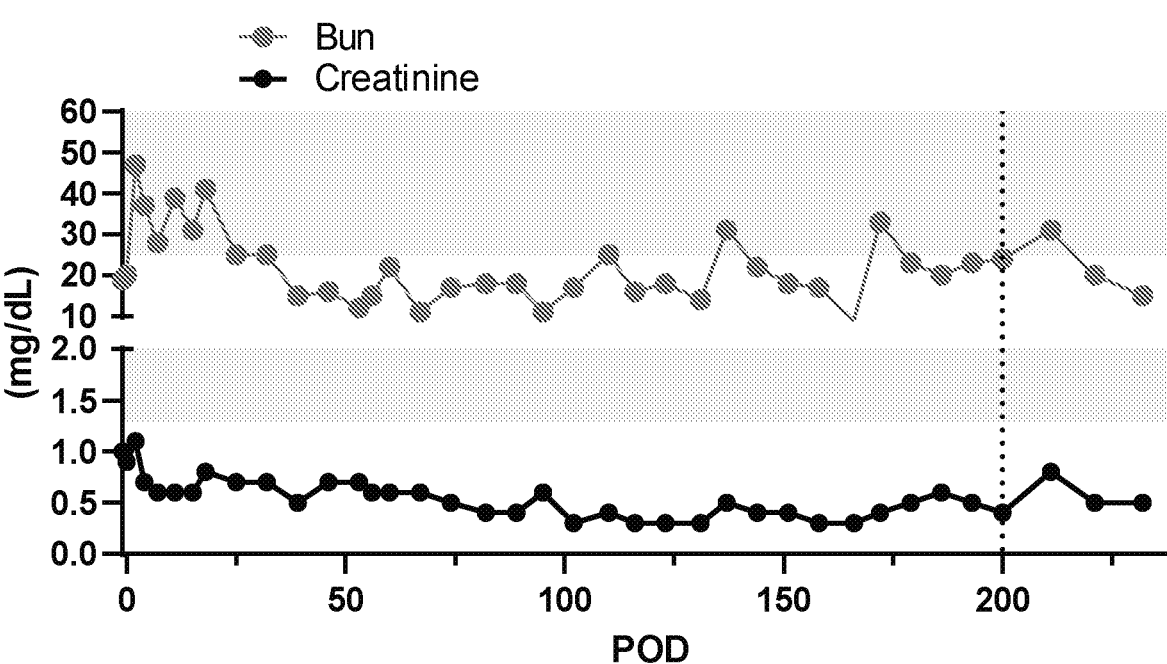
Figure 30B:
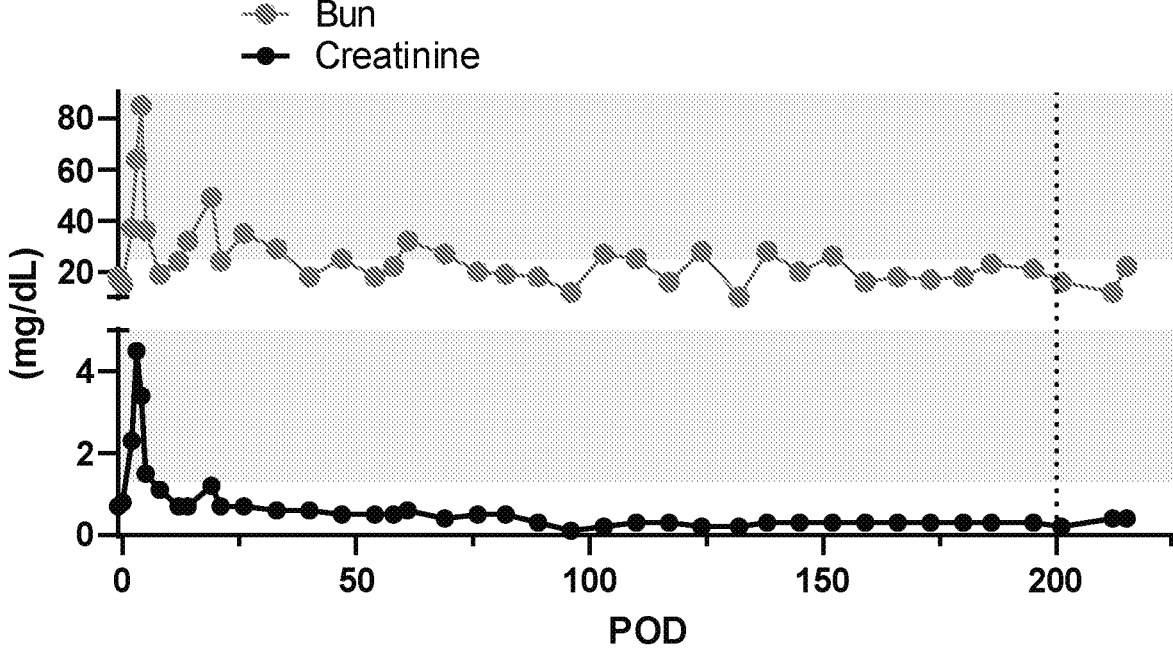

FIGS. 30A-B are graphs showing BUN and creatinine levels for two monkeys comprising TKO-G xenografts.

Figure 31:
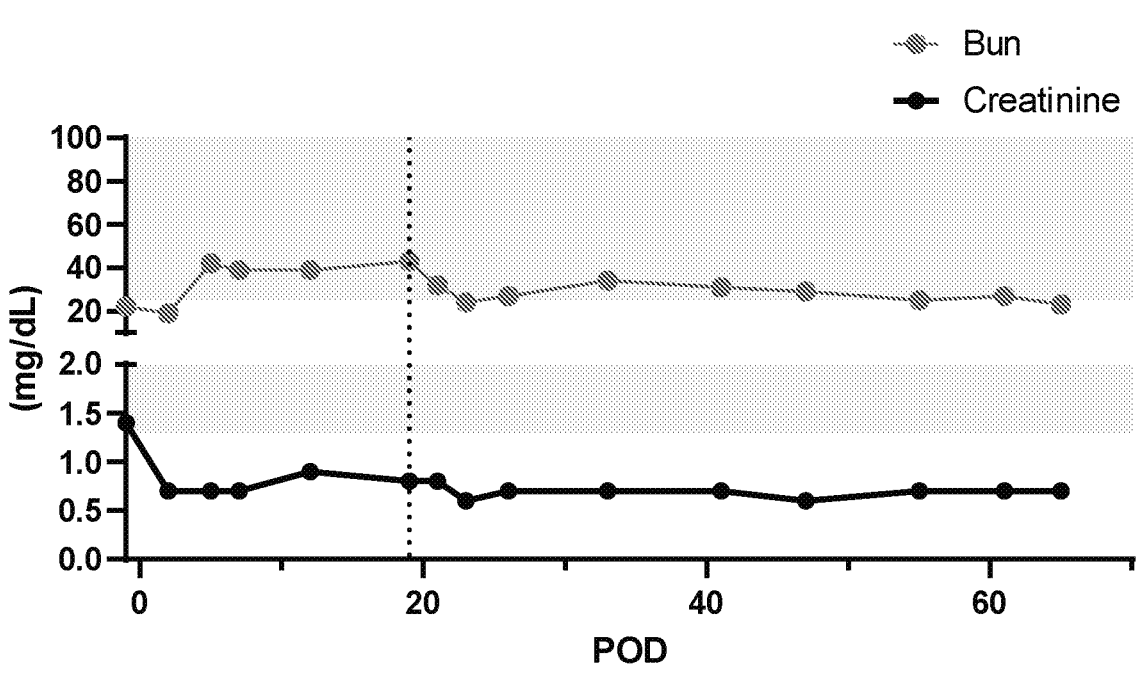
Figure 32:
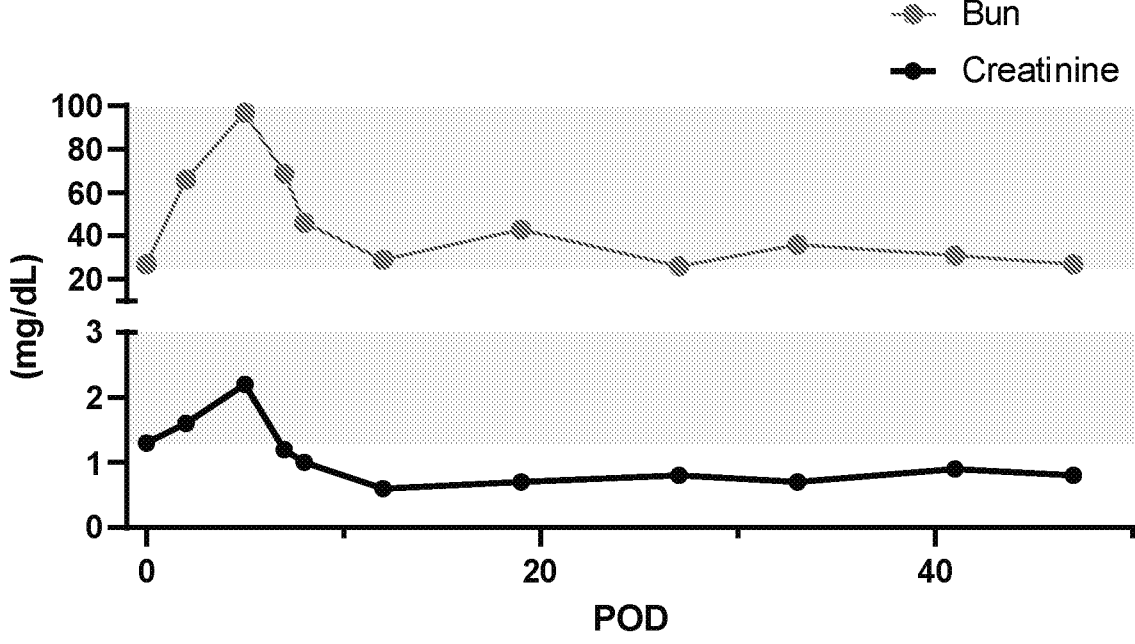

FIGS. 31 and 32 are graphs showing BUN and creatinine levels for two monkeys comprising xenografts comprising the polycistronic cassettes of FIG. 2H.

Figure 33:
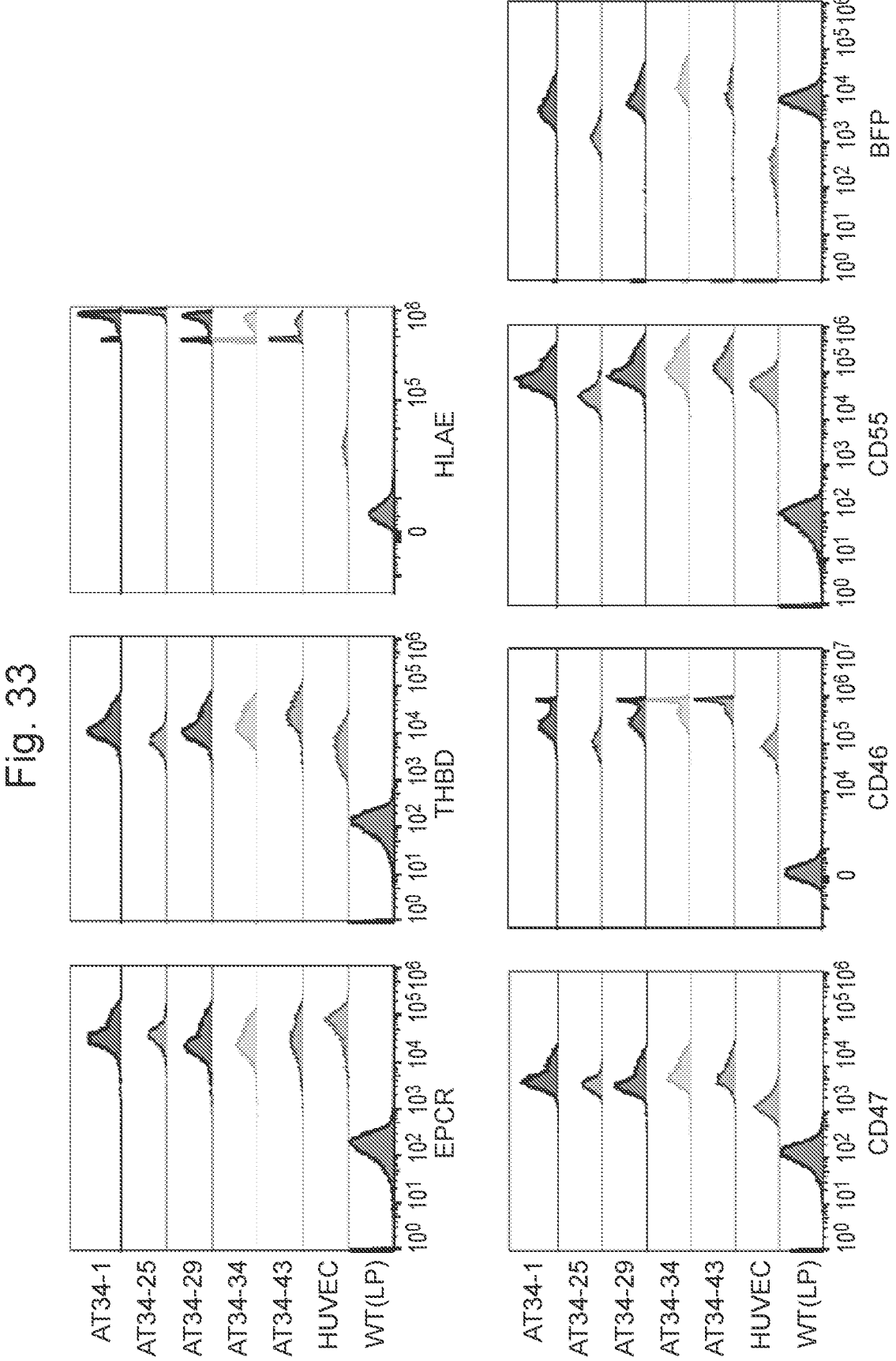

FIG. 33 shows expression of a nucleic acid comprising the polycistronic cassettes of FIG. 2E in fibroblasts from a Yorkshire pig.

Figure 34:
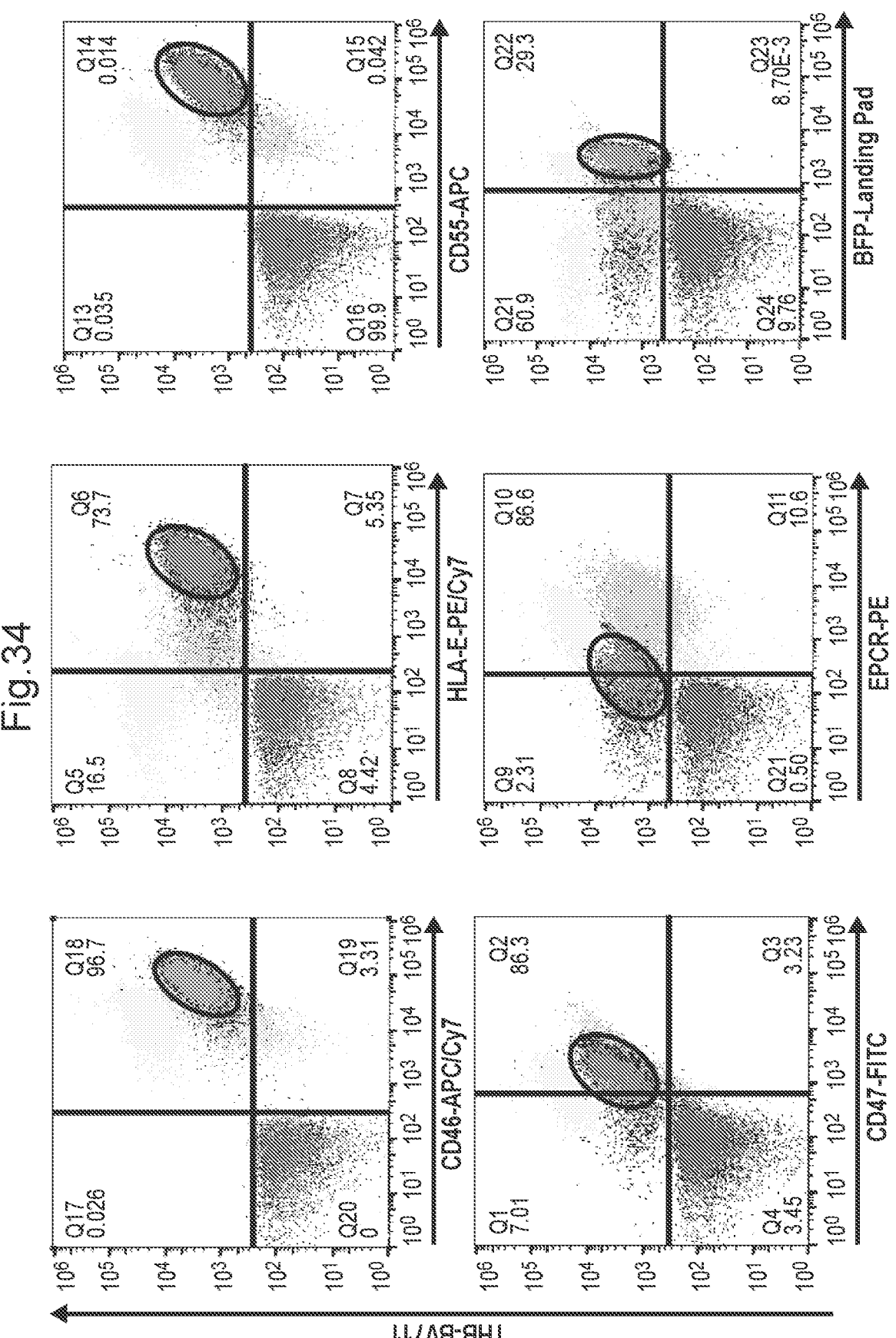

FIG. 34 (see circled cells) shows expression of a nucleic acid comprising the polycistronic cassettes of FIG. 2E in fibroblasts from a Yucatan pig.

Figure 35:
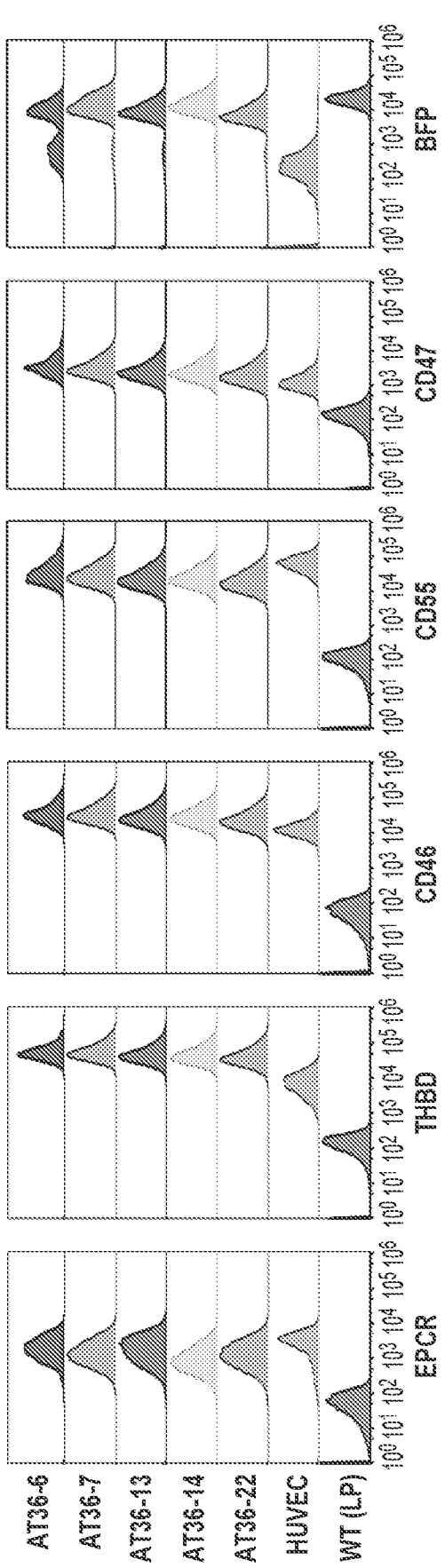

FIG. 35 shows expression of a nucleic acid comprising the polycistronic cassettes of FIG. 2D in fibroblasts from a Yucatan pig.

Figure 36:
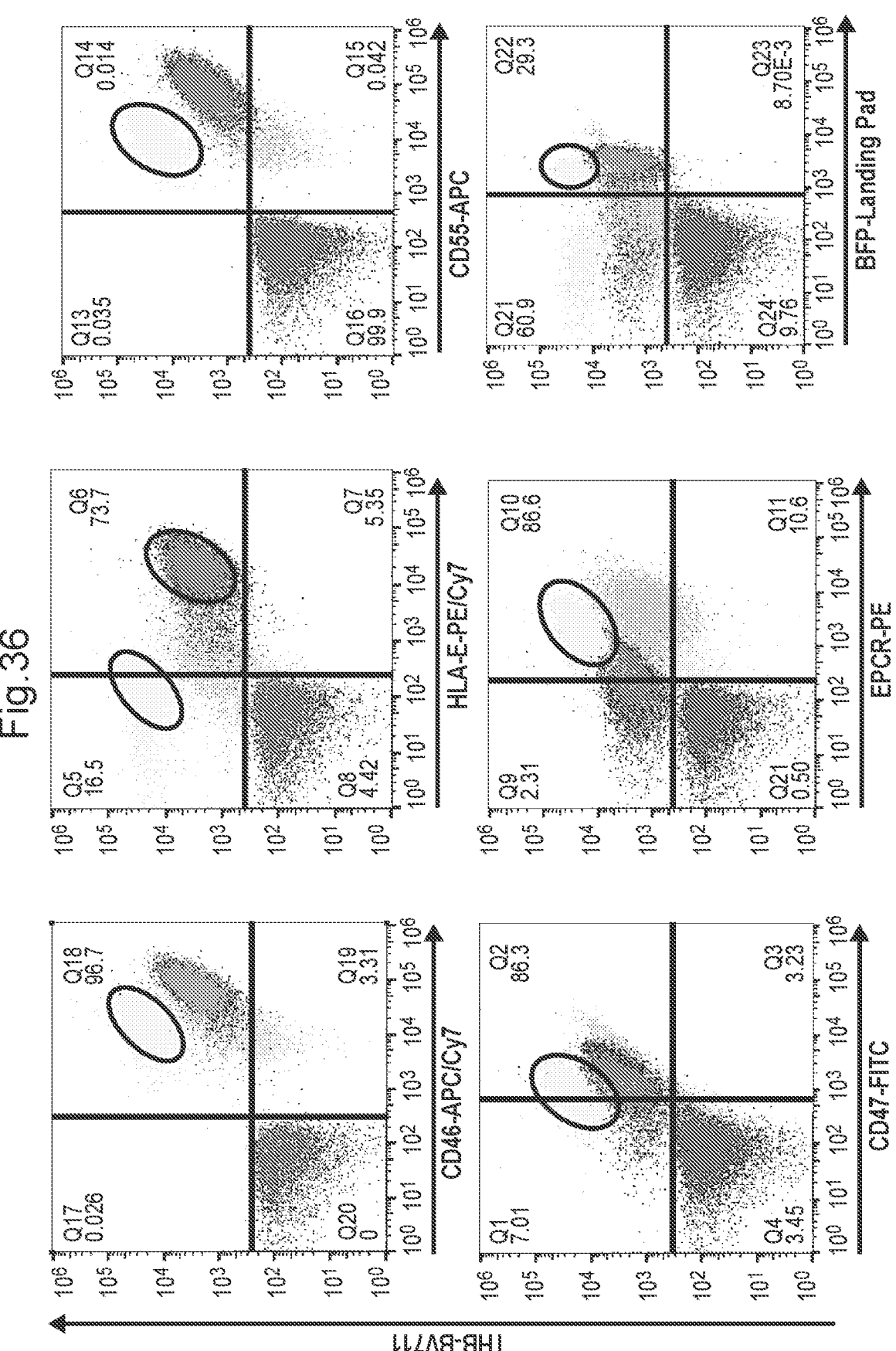

FIG. 36 (see circled cells) shows expression of a nucleic acid comprising the polycistronic cassettes of FIG. 2D in fibroblasts containing a PERV knockout from a Yucatan pig.

Figure 37B:
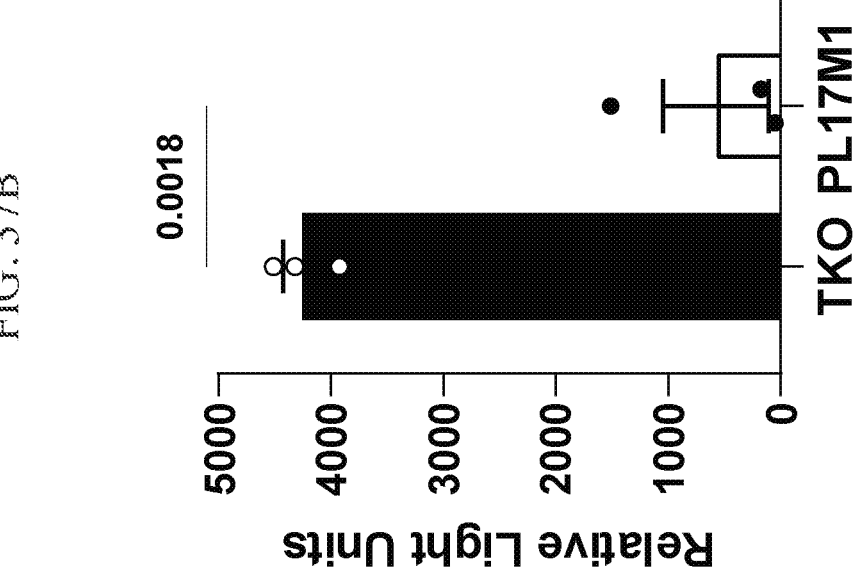
Figure 37A:
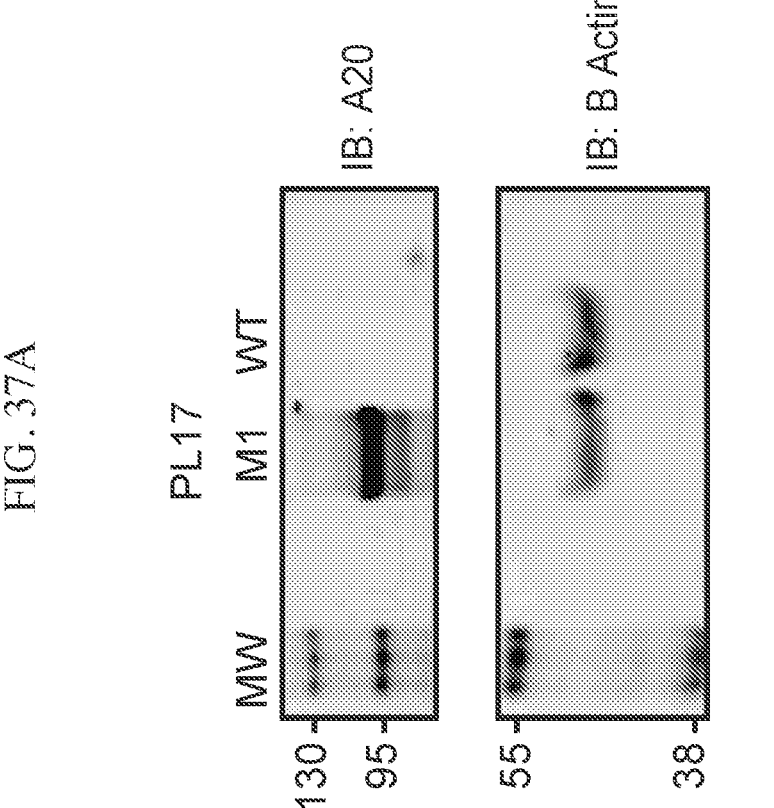

FIG. 37A shows expression of A20 in islet cells comprising the polycistronic cassettes of FIG. 4A. FIG. 37B shows that expression of A20 in islet cells comprising the polycistronic cassettes of FIG. 4B protects cells from TNFα mediated apoptosis.

Figure 38A:
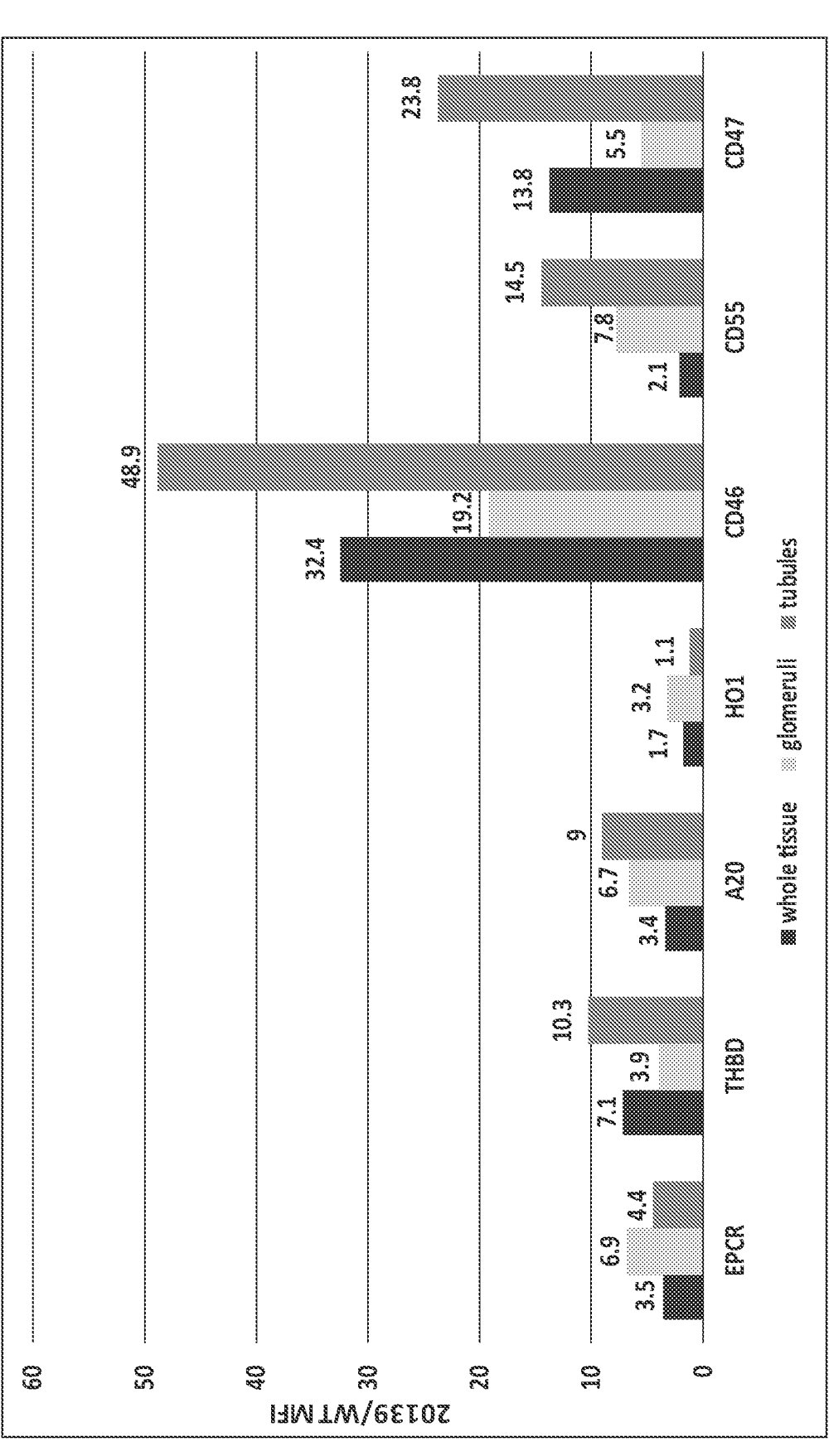
Figure 38B:
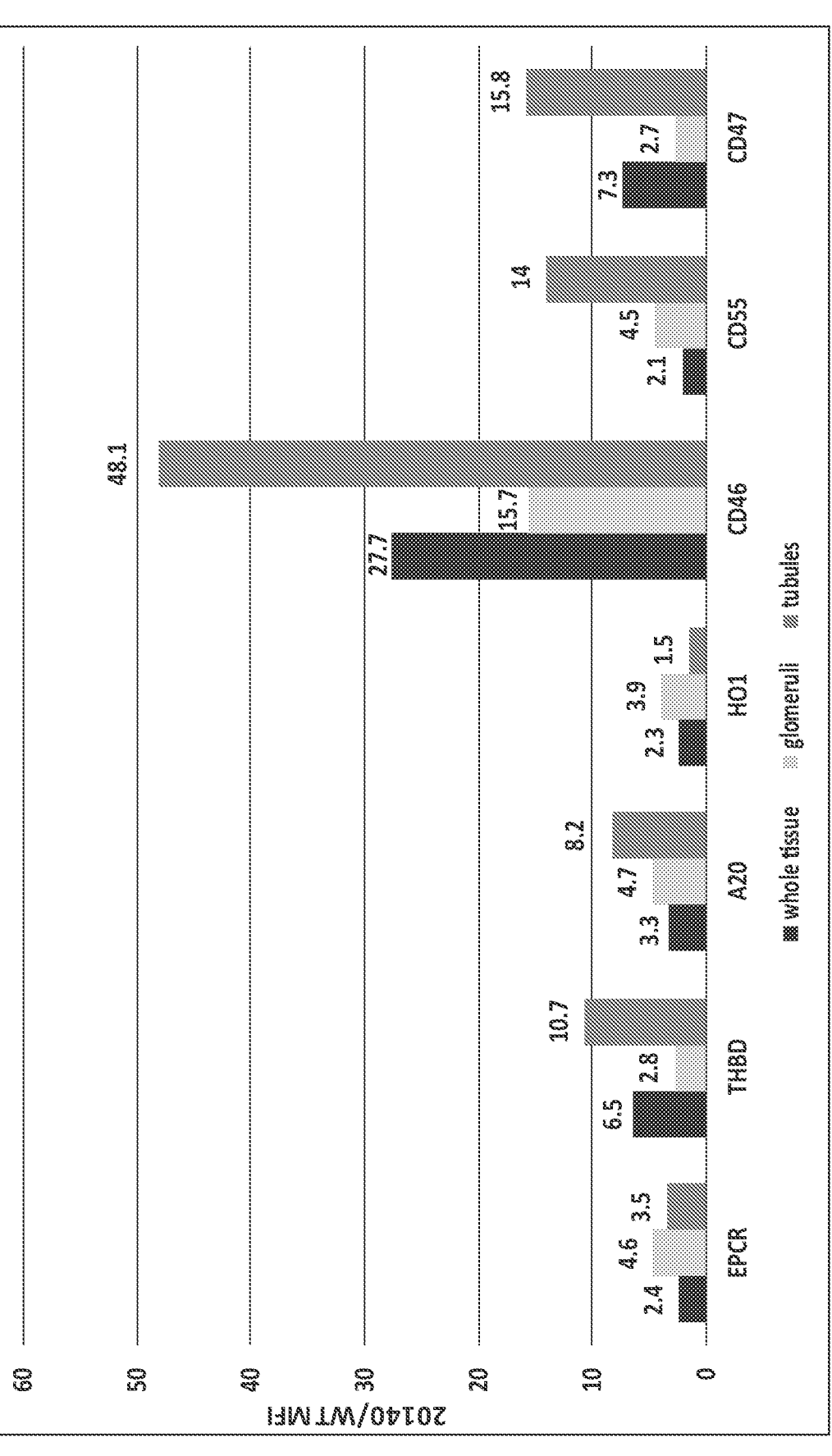
Figure 38C:

FIGS. 38A-C show expression of the transgenes of TKO-F xenografts of Example 1A in tissue, glomeruli, and tubules.

Figure 39:
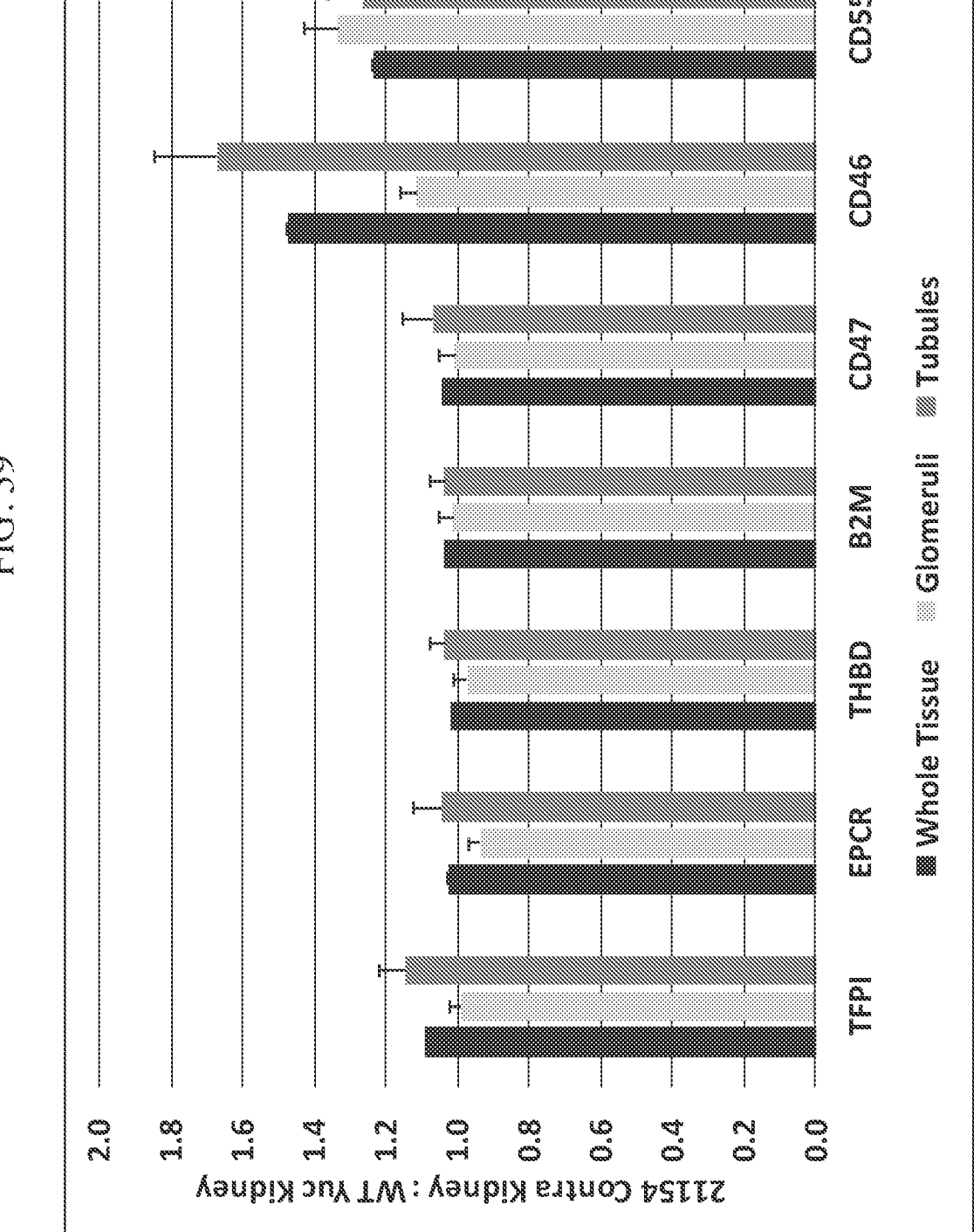

FIG. 39 shows expression of the transgenes of 15S4 in tissue, glomeruli, and tubules of monkeys comprising nucleic acids comprising the polycistronic cassettes of FIG. 2H.

Figure 40:
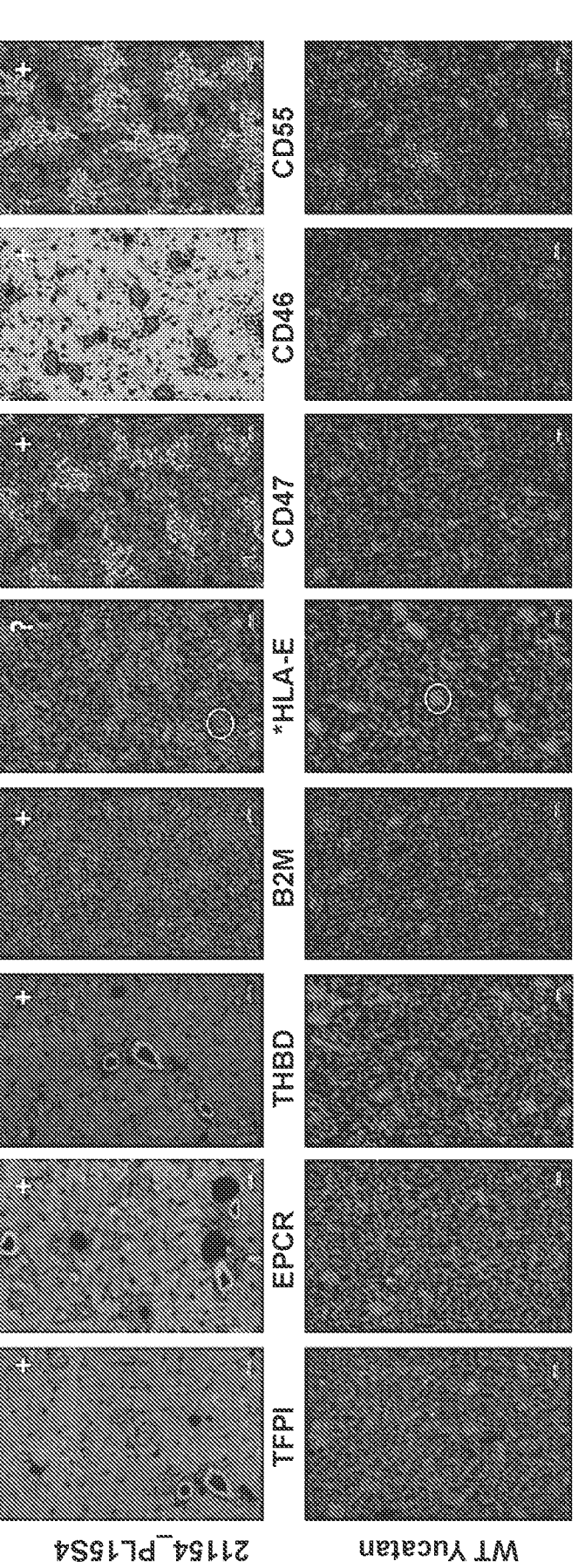

FIG. 40 shows immunohistochemistry images of transgene expression of a monkey comprising nucleic acids comprising the polycistronic cassettes of FIG. 2H.

Figure 41A:
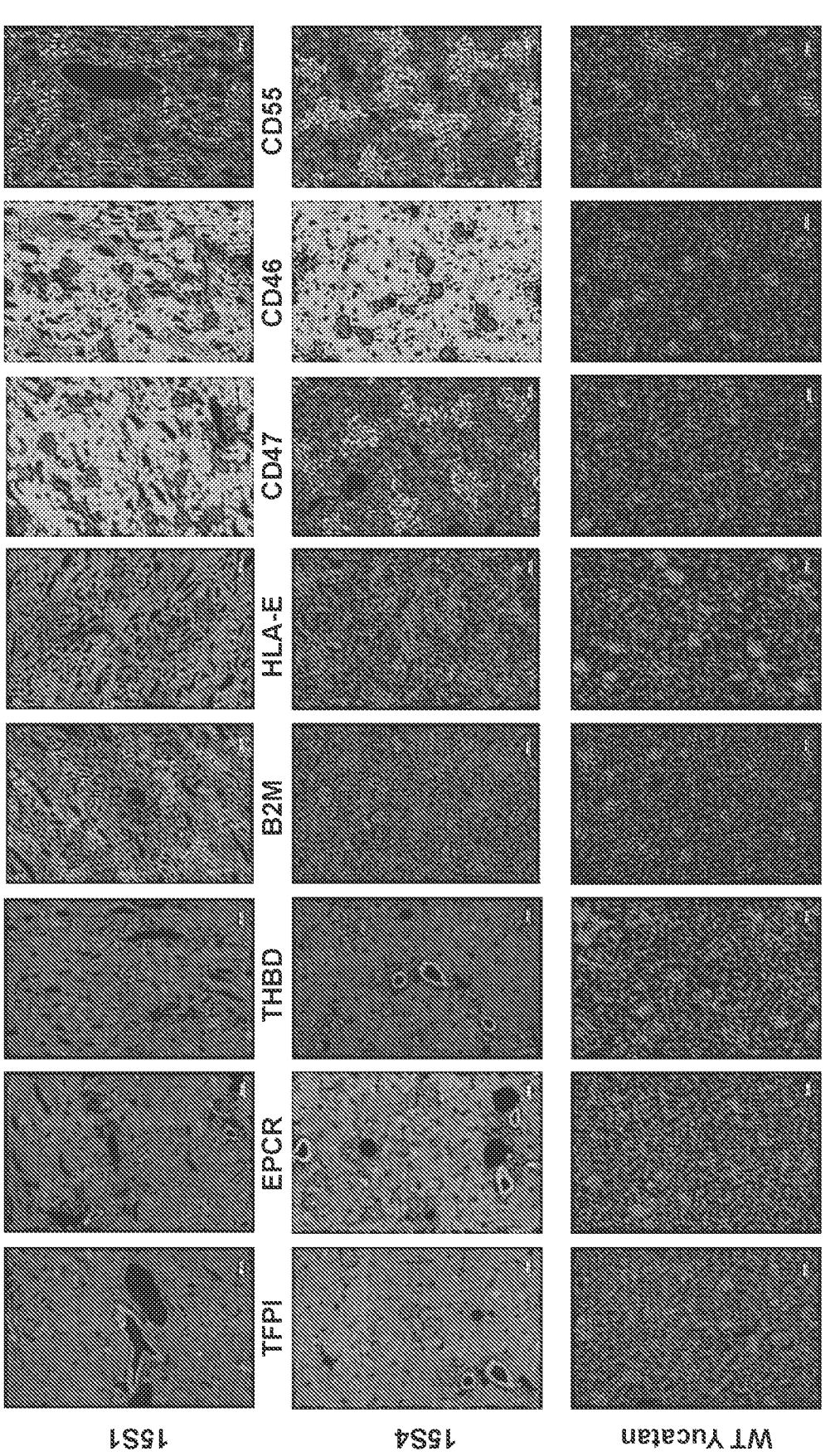
Figure 41B:
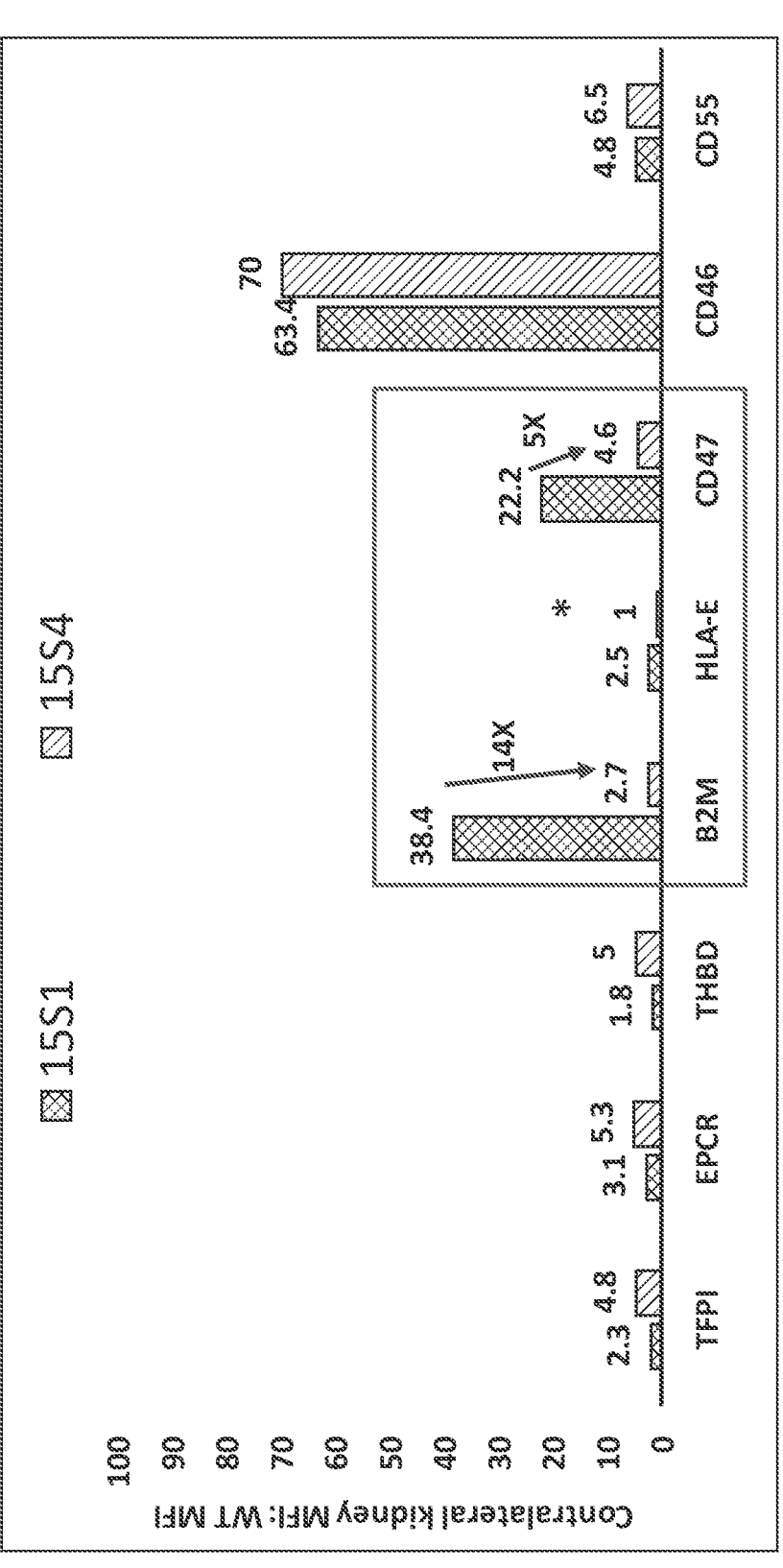
Figure 41C:
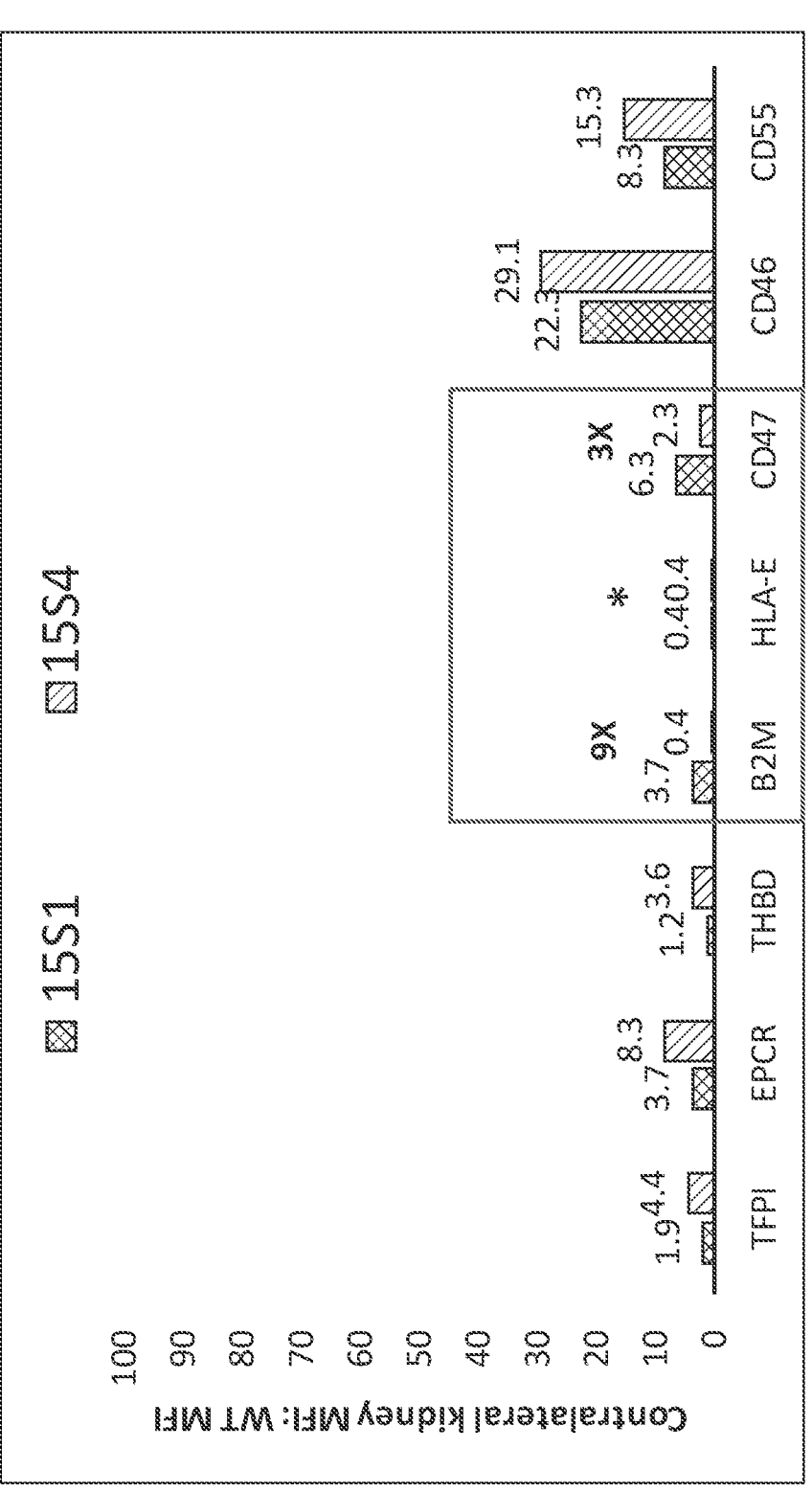
Figure 41D:
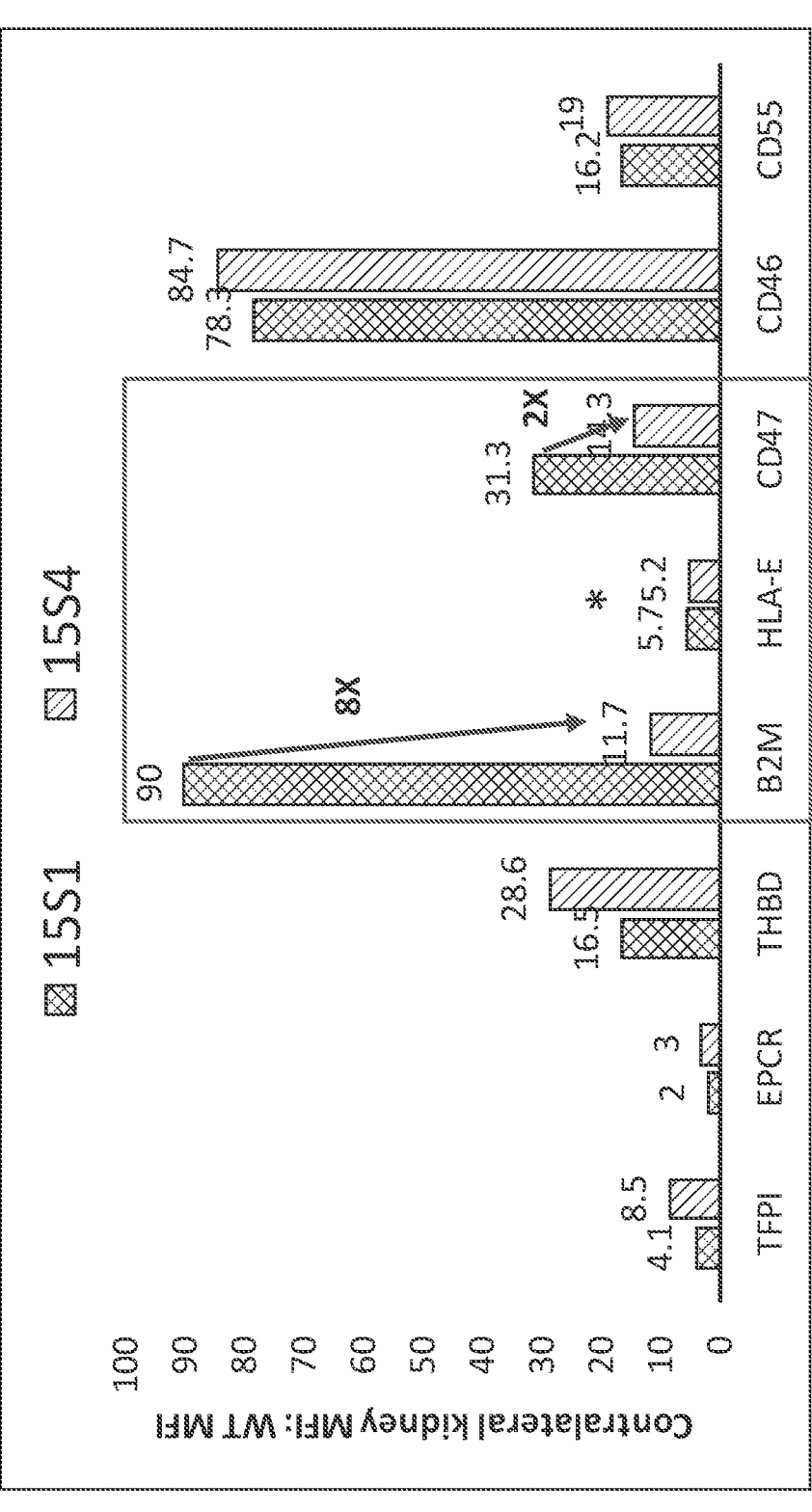

FIGS. 41A-D show comparative expression of the polycistronic cassettes of FIG. 2H ("15S4") or FIG. 2E ("15S1") in monkeys comprising kidney xenografts. FIG. 41A shows transgene expression via immunohistochemistry. FIGS. 41B-D show transgene expression in whole tissue (FIG. 41B), glomeruli (FIG. 41C), and tubules (FIG. 41D).

Figure 42A:
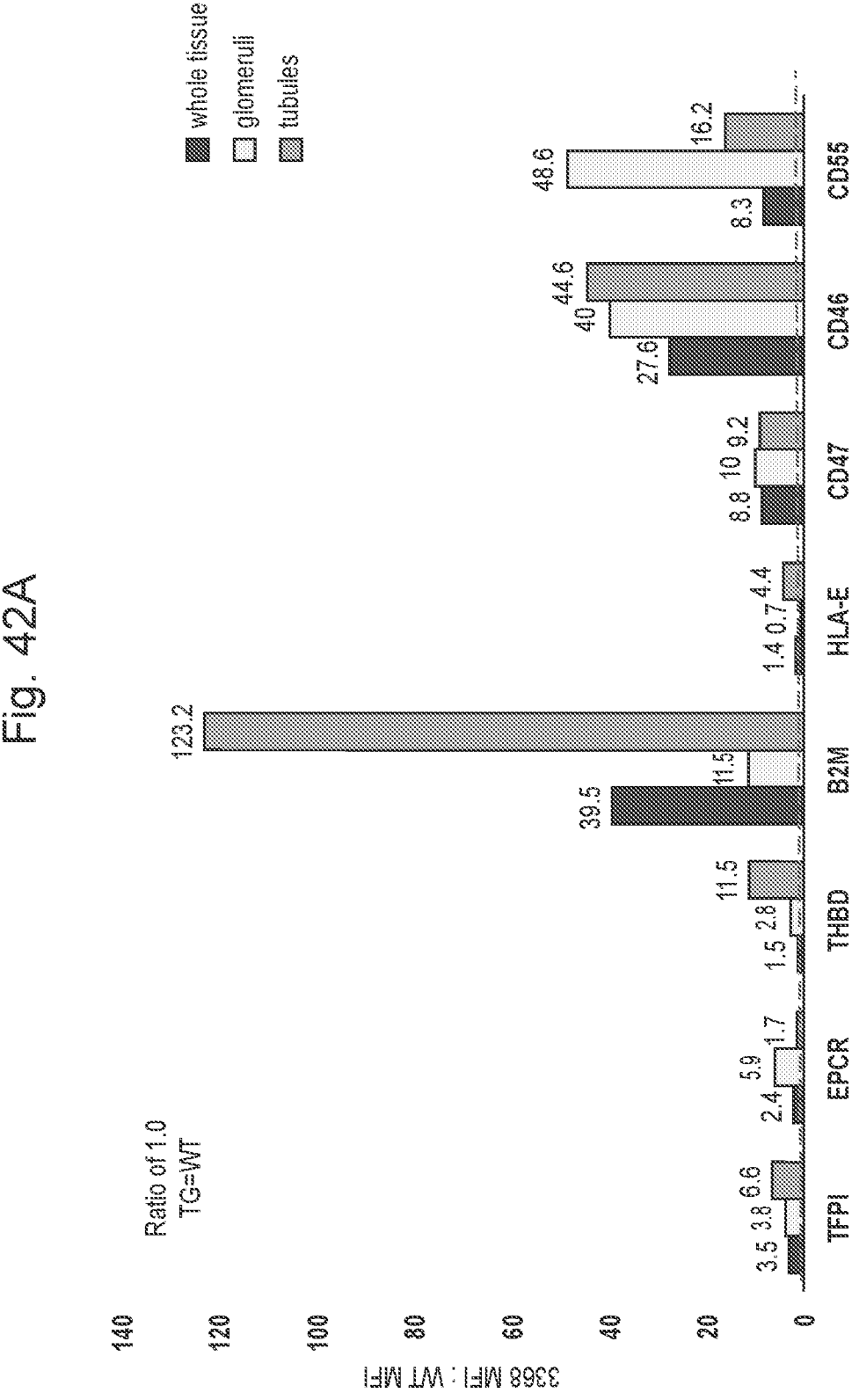
Figure 42B:
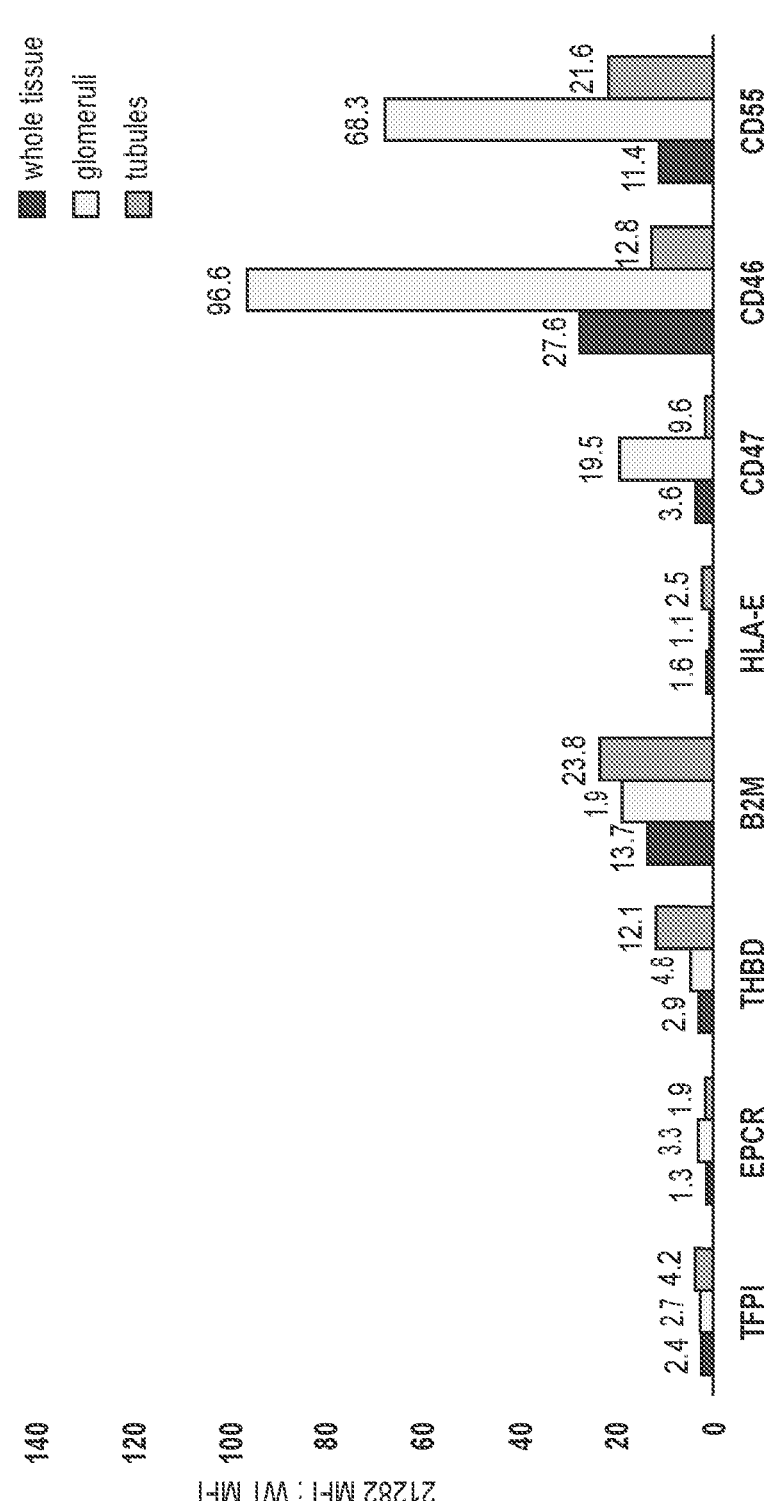
Figure 42C:
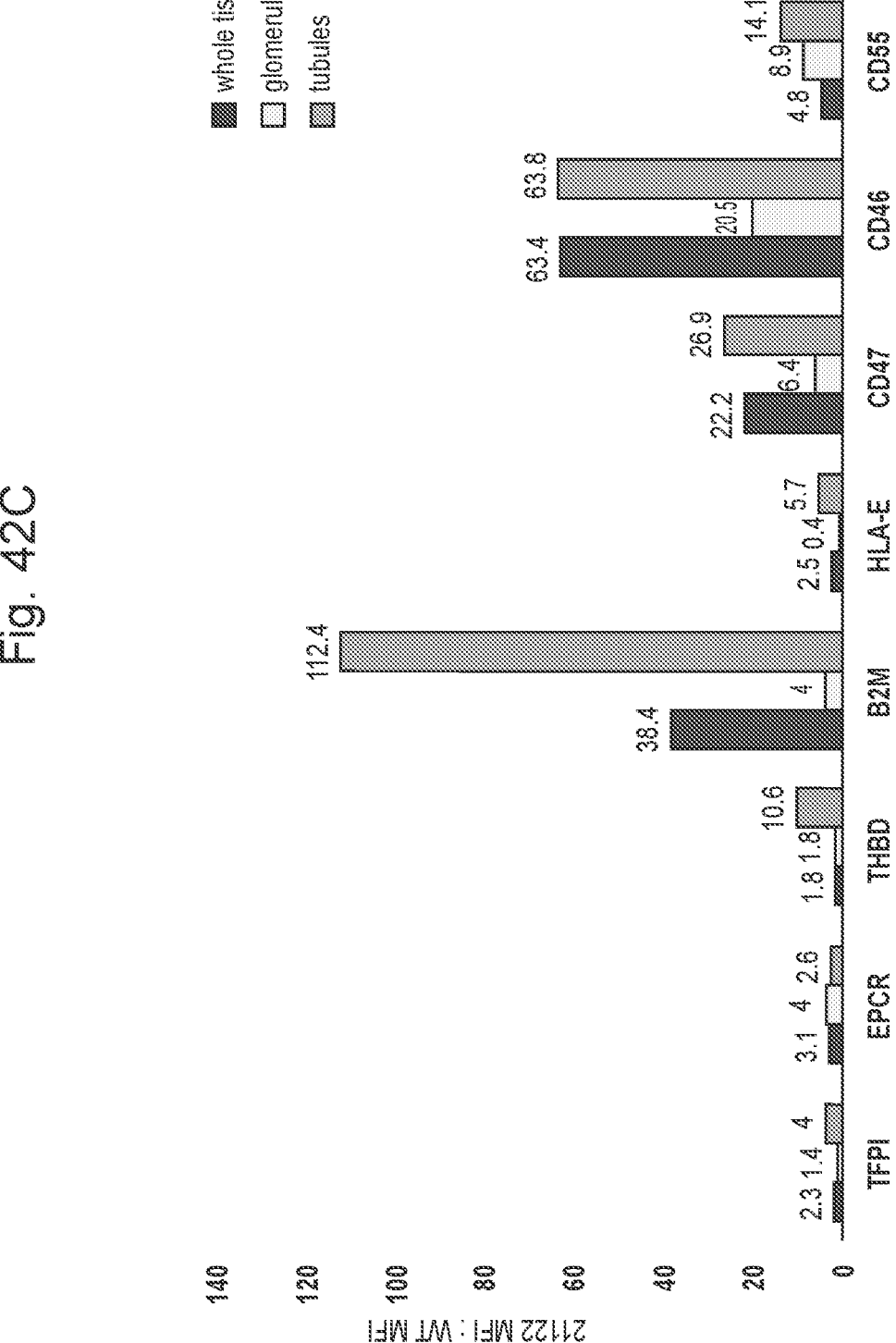

FIG. 42A shows expression of the 1551 transgenes in porcine fetal kidneys relative to expression in wild-type Yucatan pigs. FIG. 42B shows expression of the 15S1 transgenes in porcine neonatal kidneys relative to expression in wild-type Yucatan pigs. FIG. 42C shows expression of the 15S1 transgenes in porcine adult kidneys relative to expression in wild-type Yucatan pigs.

Figure 43A:
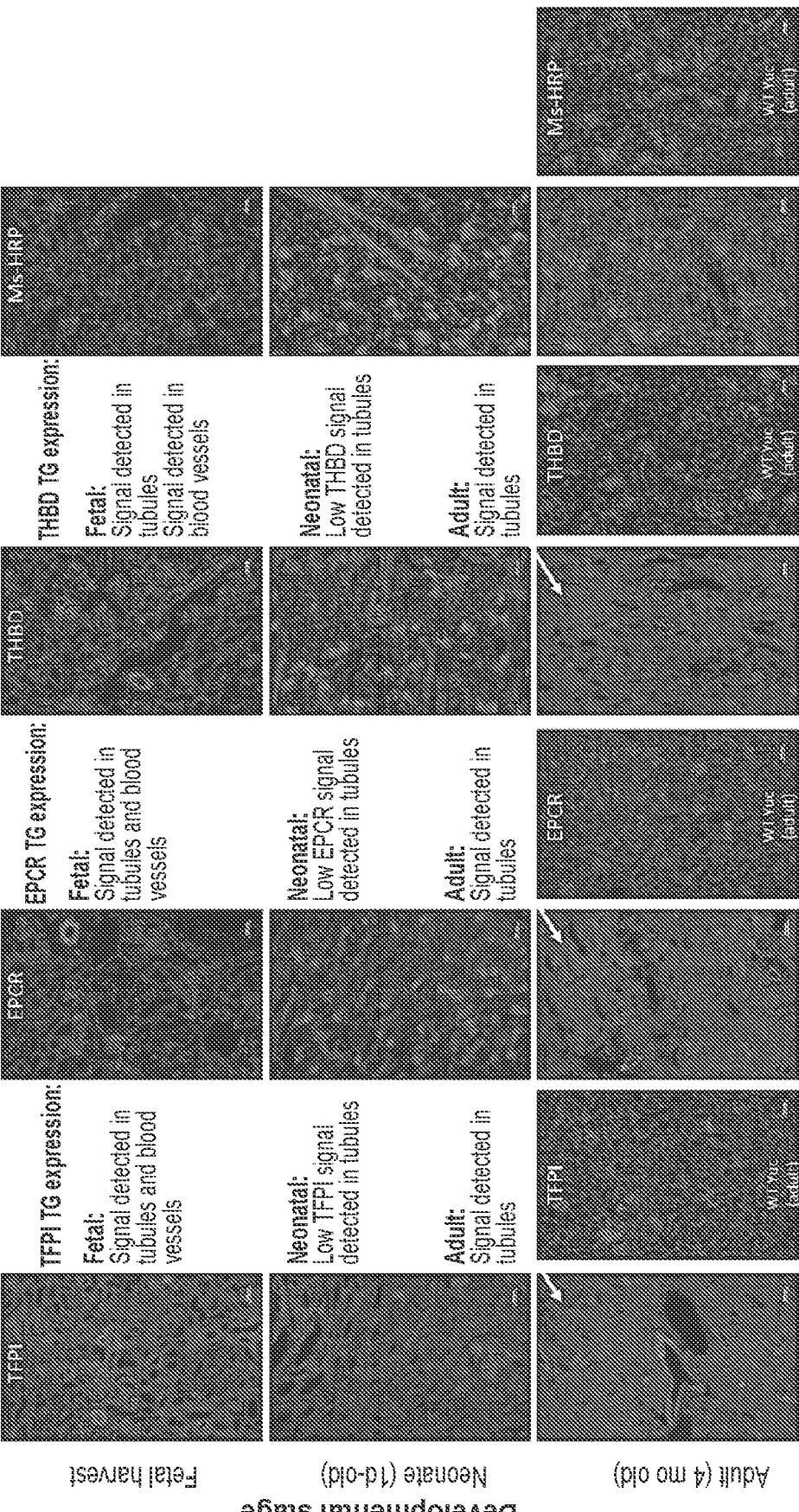
Figure 43B:
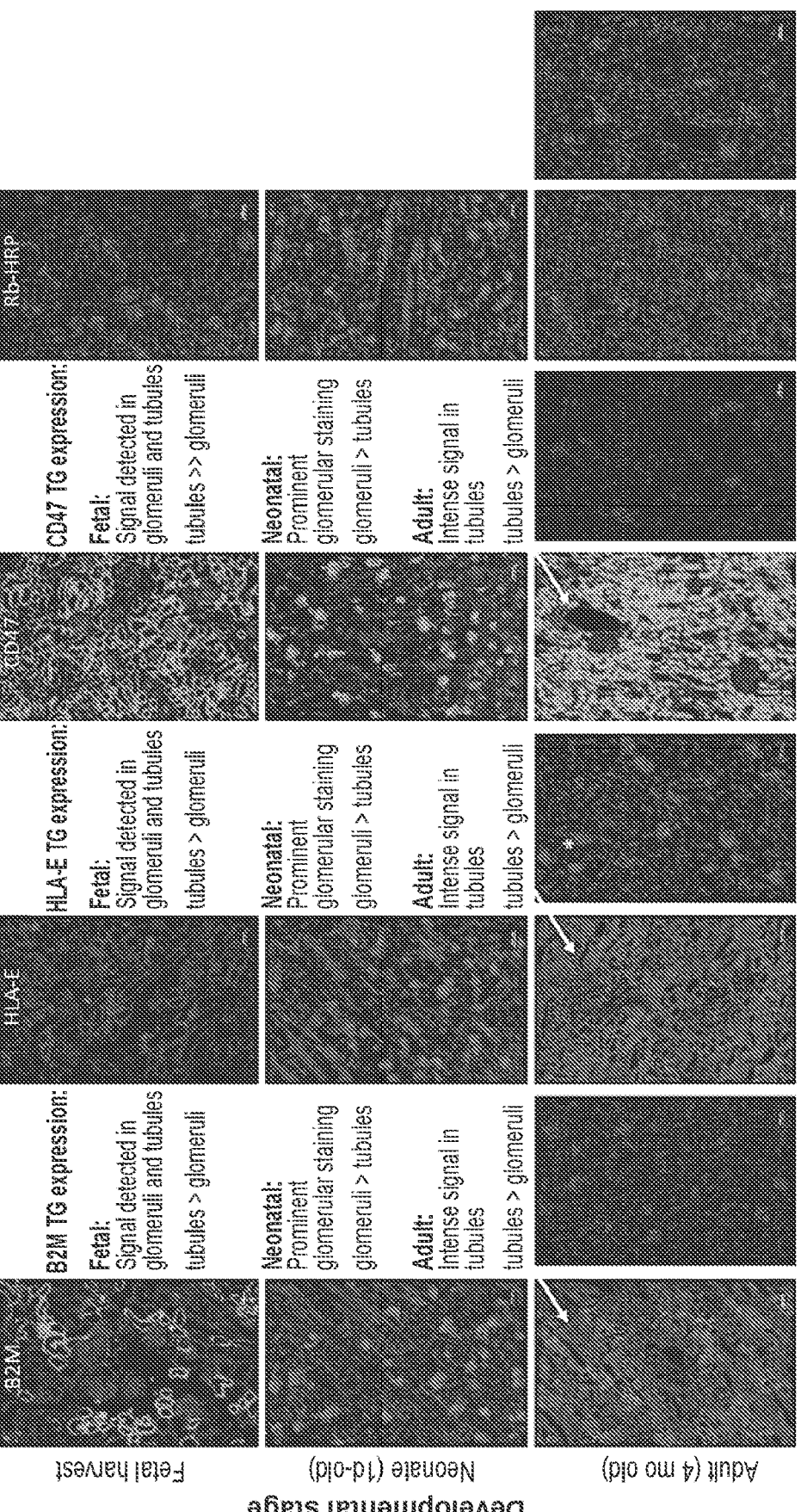
Figure 43D:
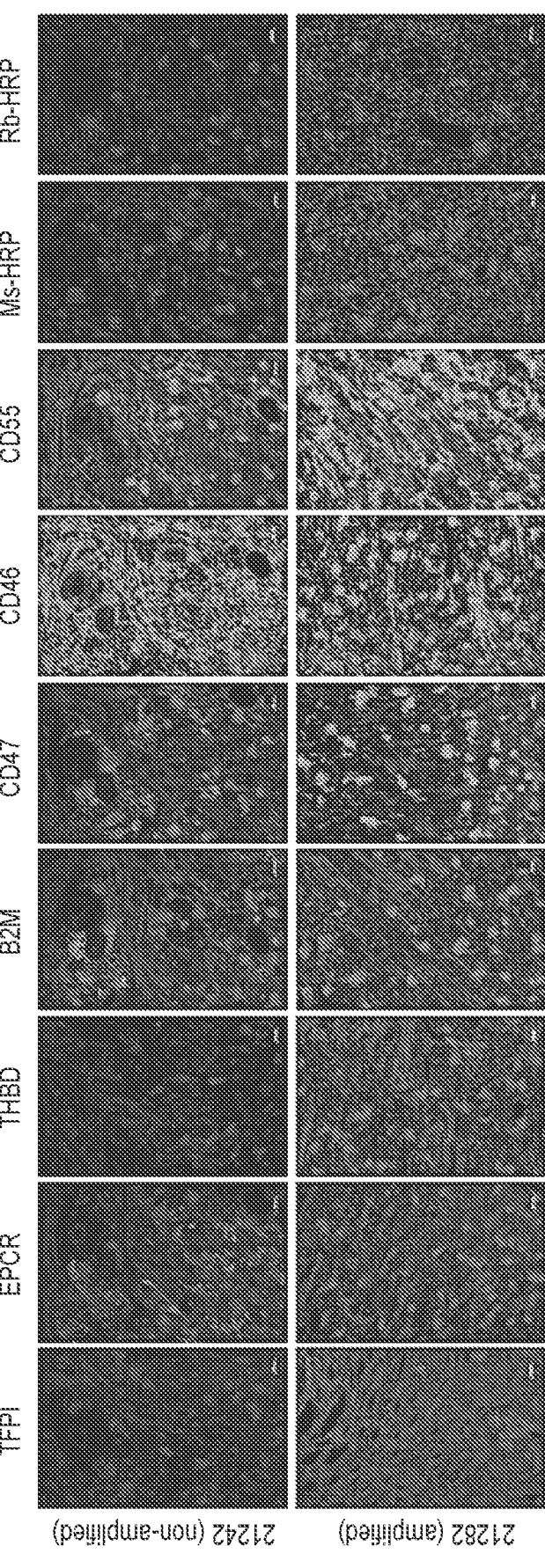

FIG. 43A shows expression of the 15S1 transgenes TFPI, EPCR, and THBD in porcine fetal, neonatal, and adult kidney tissues. FIG. 43B shows expression of the 15S1 transgenes B2M HLA-E fusion protein and CD47 in porcine fetal, neonatal, and adult kidney tissues. FIG. 43C shows expression of the 15S1 transgenes CD46 and CD55 in porcine fetal, neonatal, and adult kidney tissues. FIG. 43D shows expression of each of the 15S1 transgenes in two different fetal porcine kidney tissues.

FIG. 44 shows expression of CD47 by islet cells comprising a nucleic acid comprising the polycistronic cassettes of FIG. 2H ("15S4") or FIG. 4A ("17M1").

Figure 45:
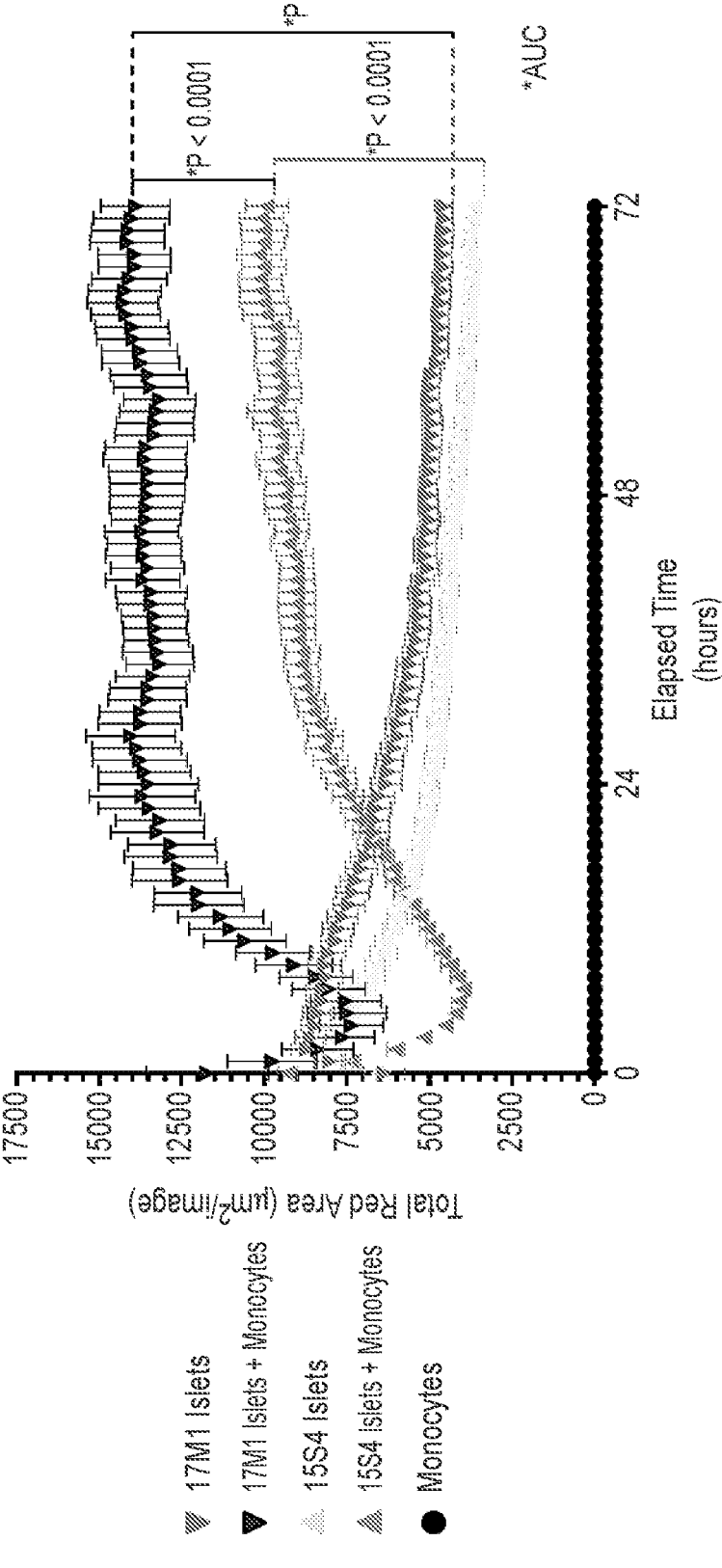

FIG. 45 shows that dissociated islet cells comprising the polycistronic cassettes of FIG. 2H ("15S4") are superior at protecting from phagocytosis than islet cells comprising the polycistronic cassettes of FIG. 4A ("17M1").

Figure 46:
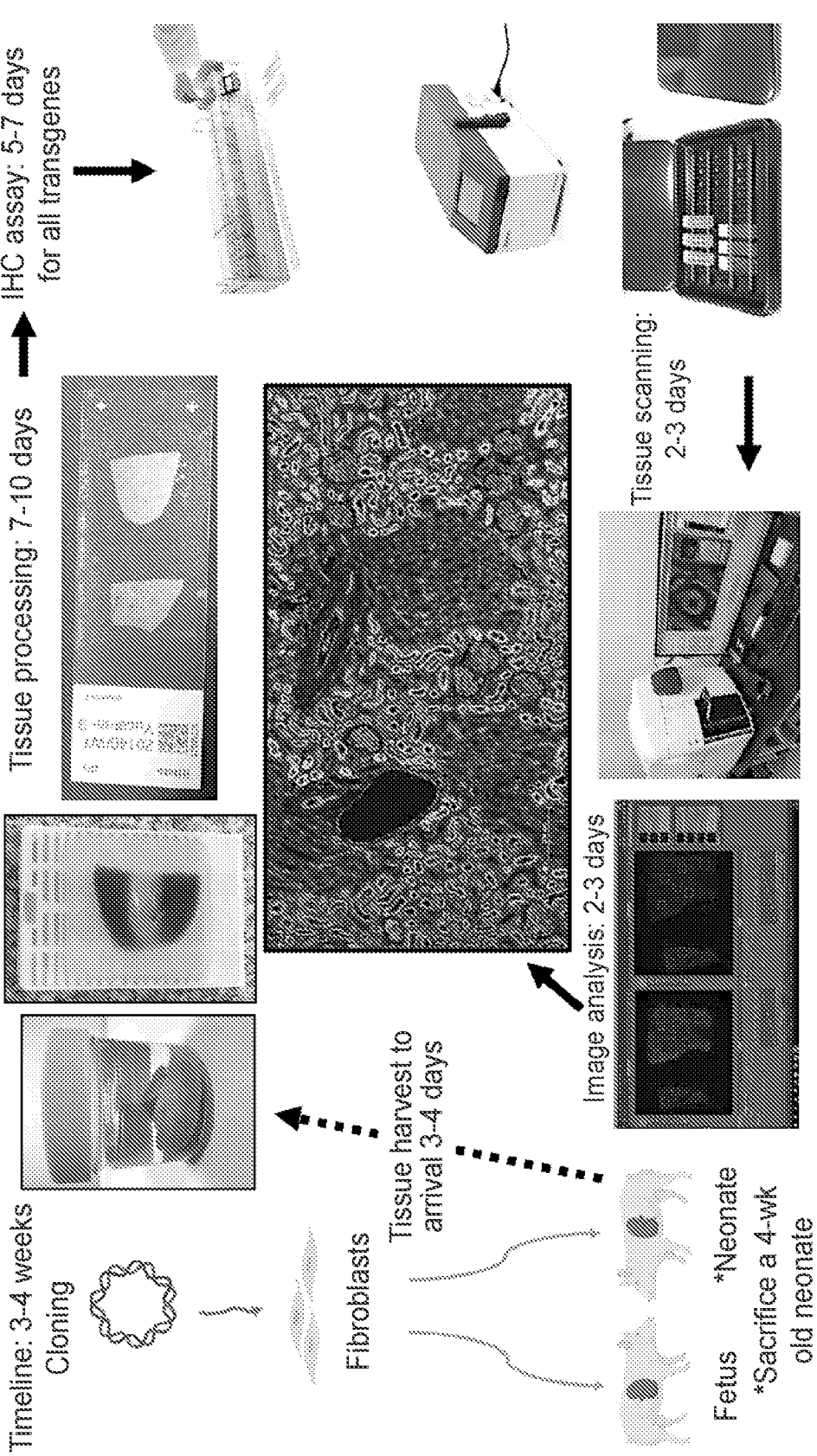

FIG. 46 provides an example of how a transgenic pig comprising the nucleic acids described herein is produced.

Figure 47A:
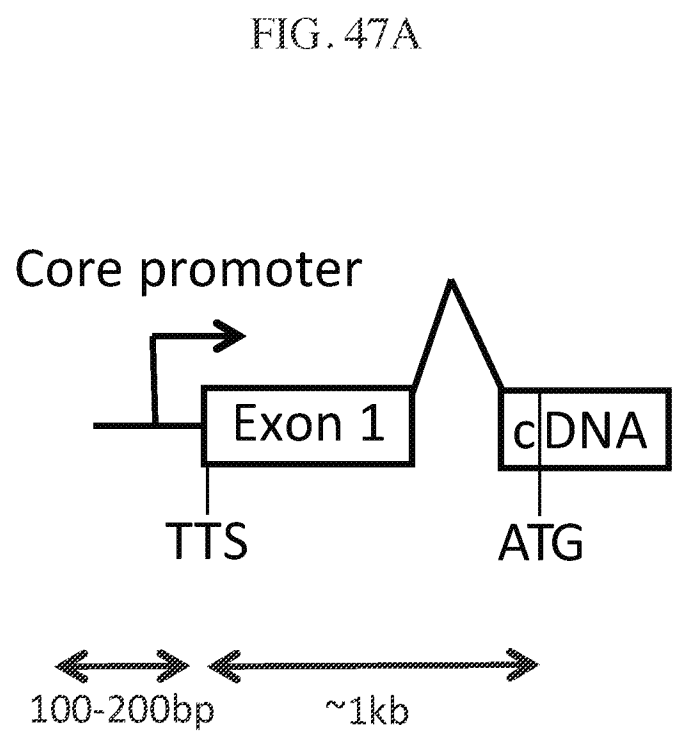
Figure 47B:
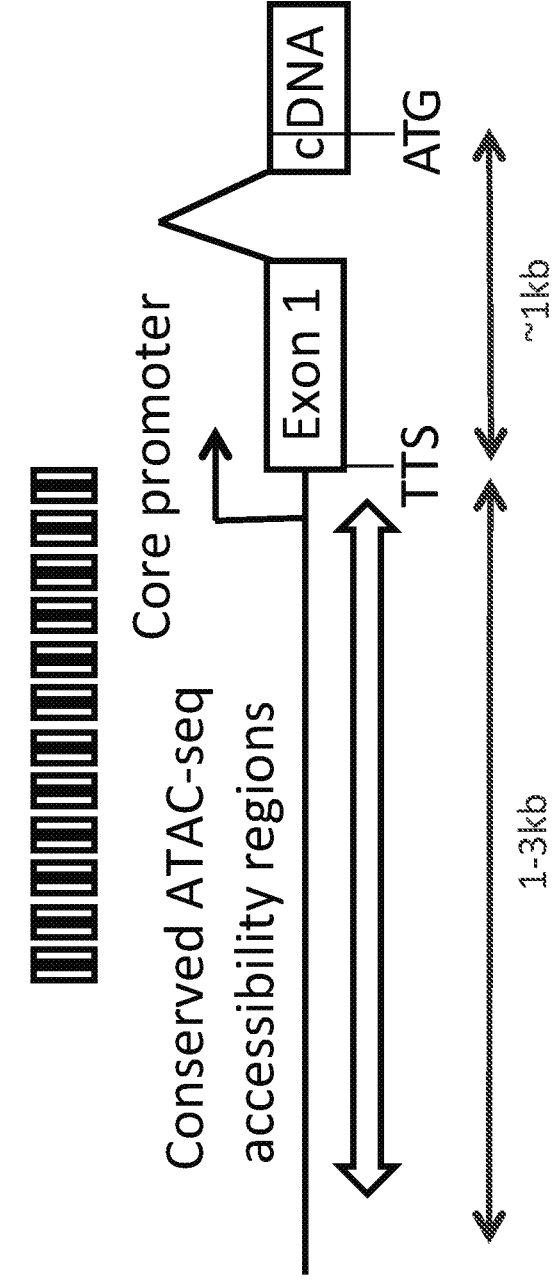

FIG. 47A is an illustration of a standard promoter. FIG. 47B is an illustration of a promoter comprising a CpG island.

FIGS. 48A-C show expression of a CD47 cistron using promoters comprising or lacking CpG islands in fibroblasts (FIG. 48A), beta islet cells (FIG. 48B), and pAEC-SV40 cells (FIG. 48C). FIGS. 48D-F show expression of CD46 using promoters comprising or lacking CpG islands in fibroblasts (FIG. 48D), beta islet cells (FIG. 48E), and pAEC-SV40 cells (FIG. 48F). The x-axis of each of the graphs of FIGS. 48A-F indicates the SEQ ID NO: of the promoter used to express the cistron.

Figure 49:
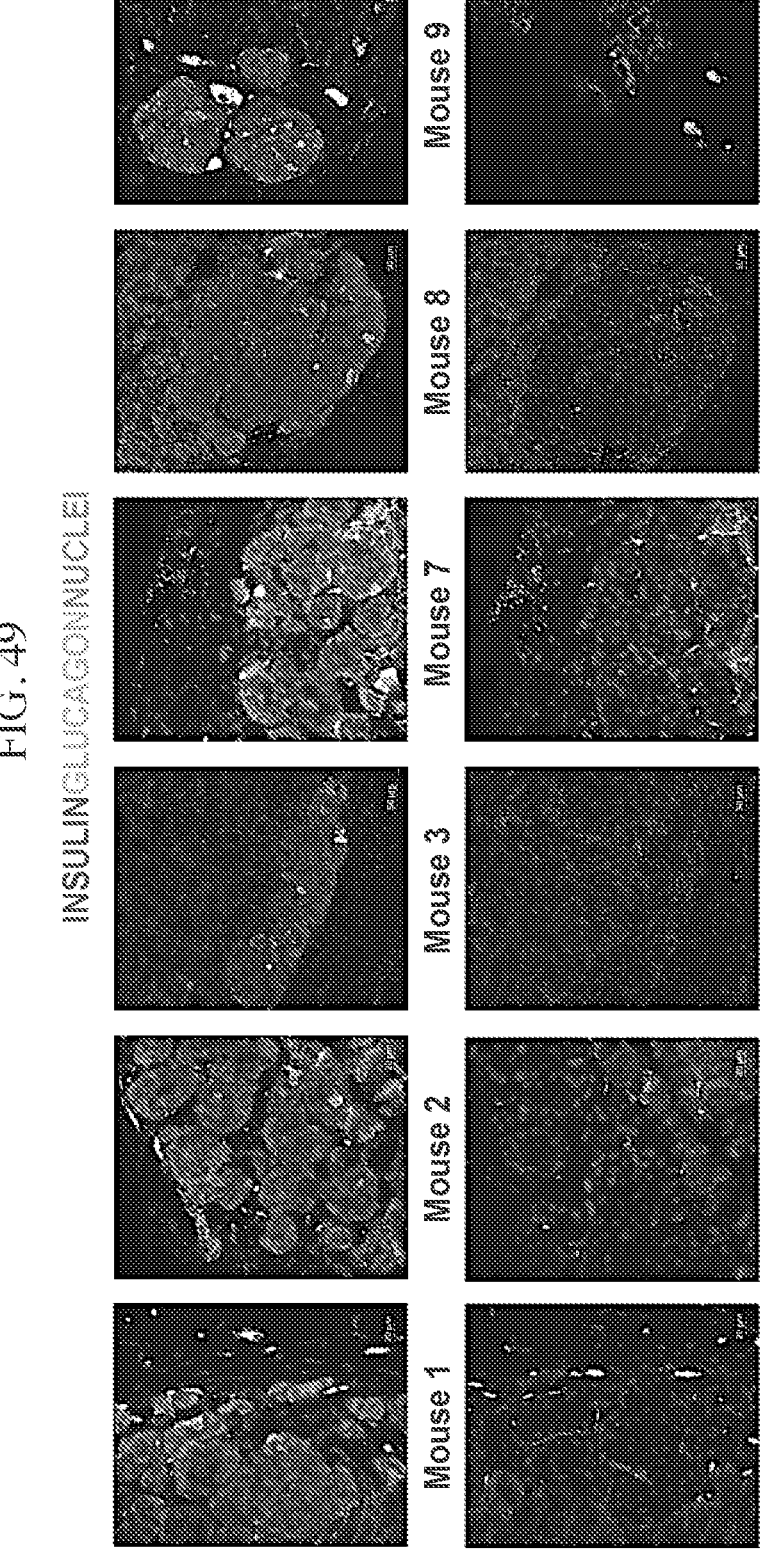

FIG. 49 shows immunohistochemistry images of islet cells comprising a nucleic acid comprising the polycistronic cassettes of FIG. 4A that were transplanted in diabetic mice. The images show staining for insulin, glucagon, and nuclei in individual mice.

Figure 50:
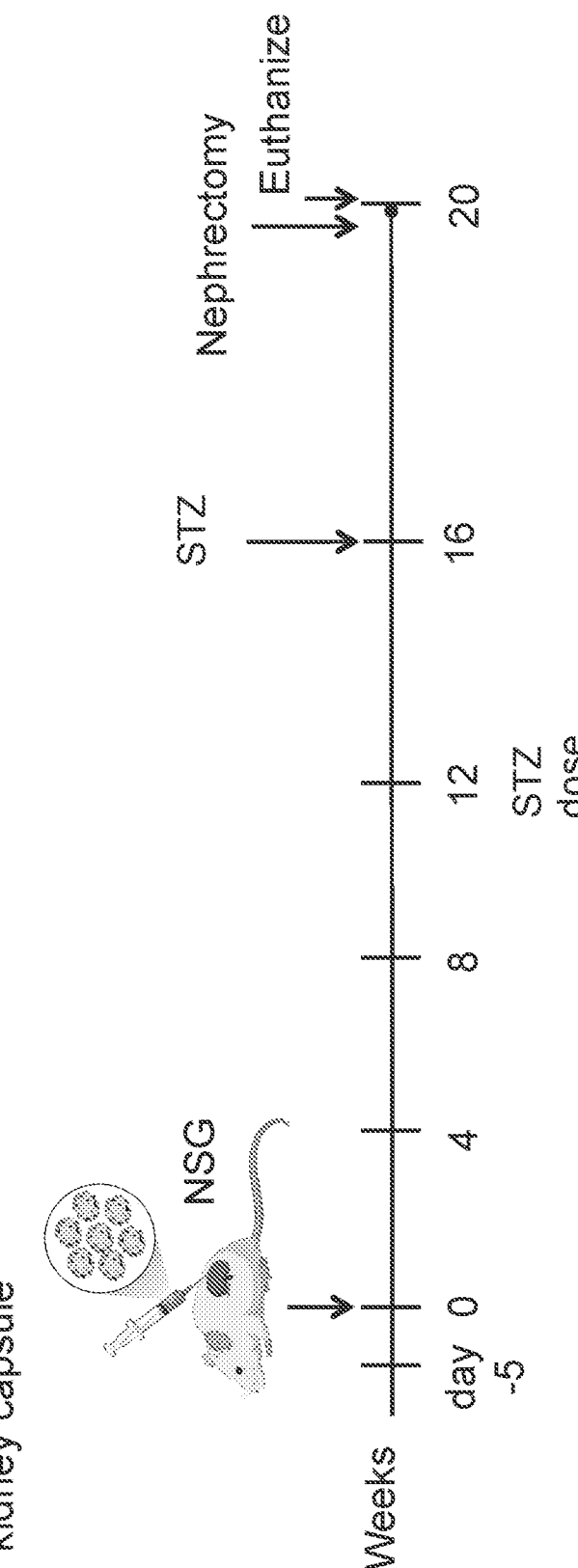

FIG. 50 shows the experimental design of the experiment of Example 16.

Figure 51:
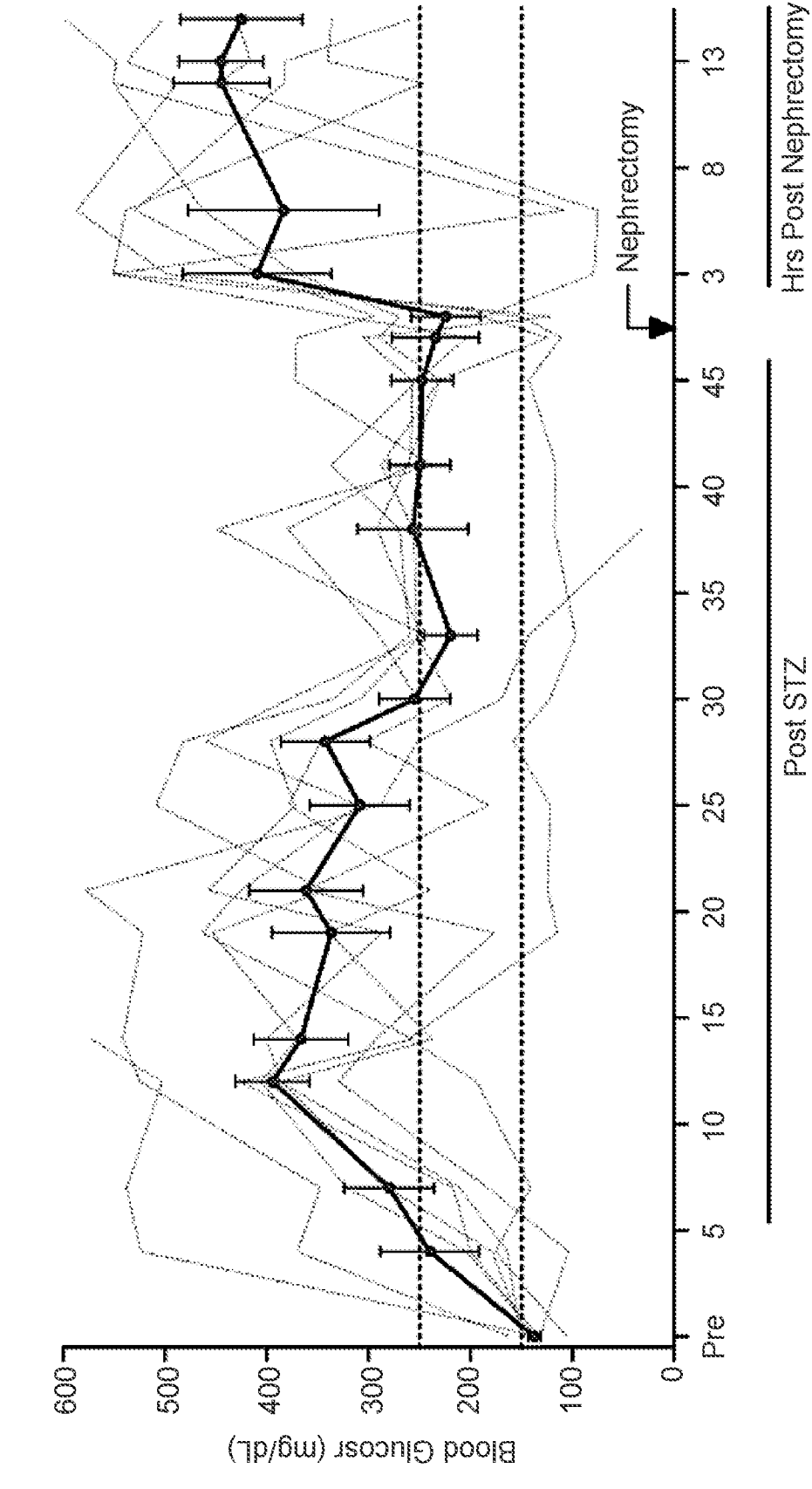

FIG. 51 shows blood glucose levels of NSG mice that received transplants of neonatal porcine islets comprising nucleic acids comprising the polycistronic cassettes of FIG. 4A.

Figure 52A:
Figure 52B:
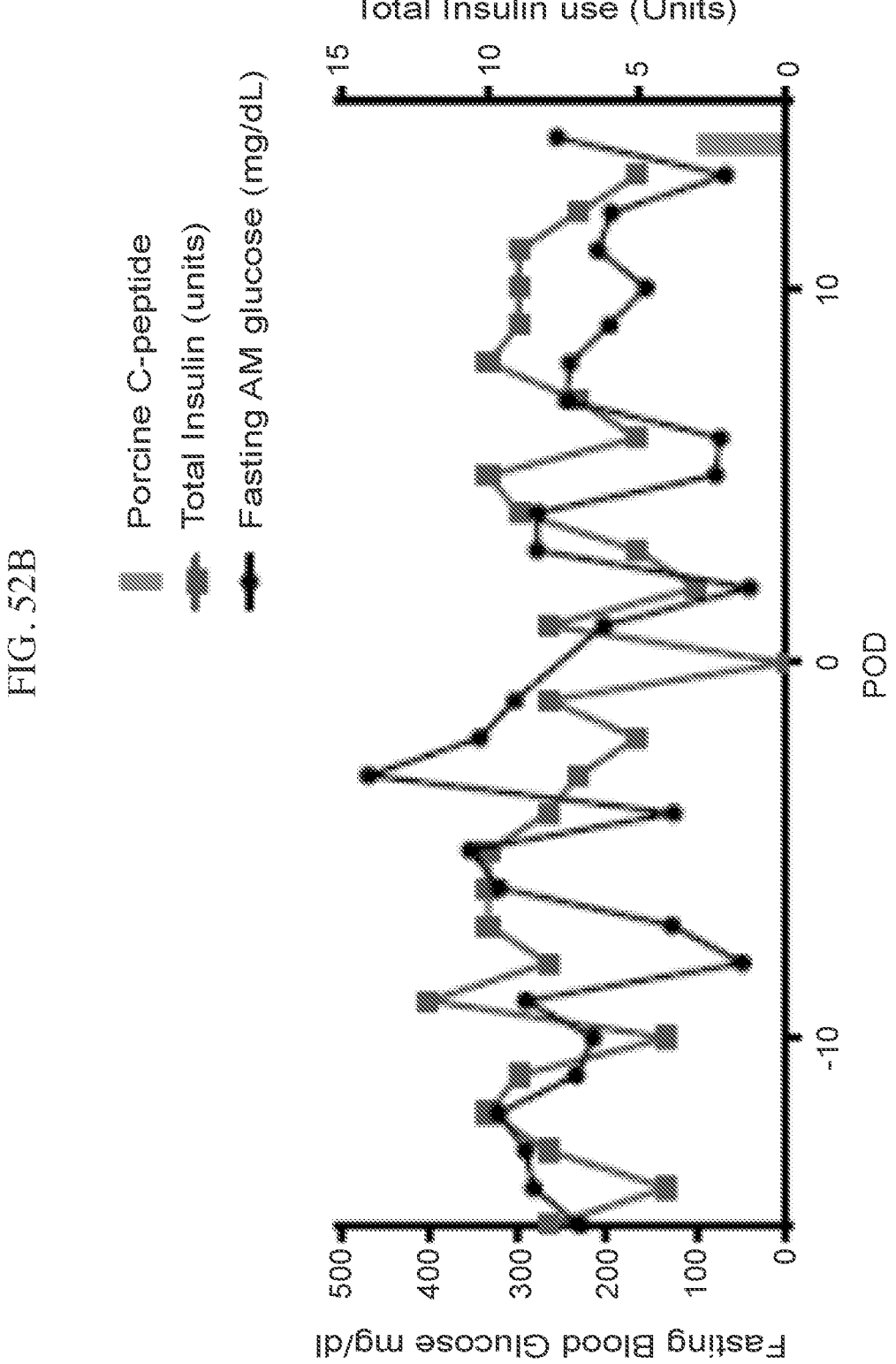

FIGS. 52A-B show fasting blood glucose concentrations, total insulin, and porcine C-peptide in two cynomologus monkeys that received transplants of neonatal porcine islets comprising nucleic acids comprising the polycistronic cassettes of FIG. 4A.

Figure 53B:
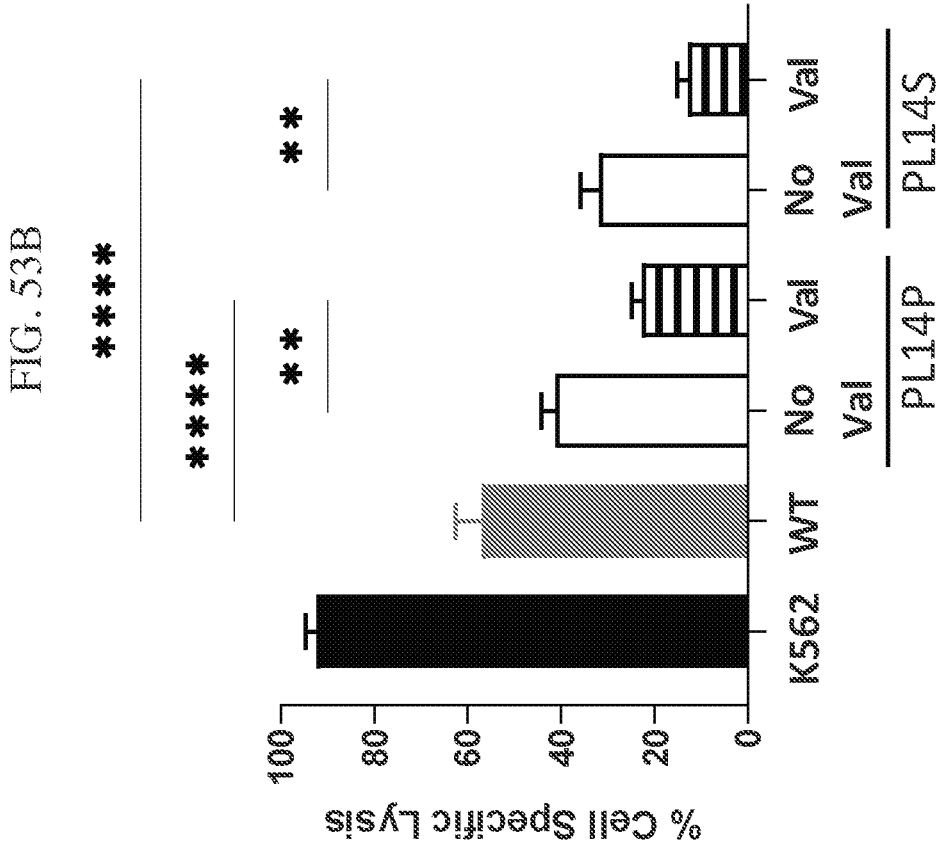
Figure 53A:
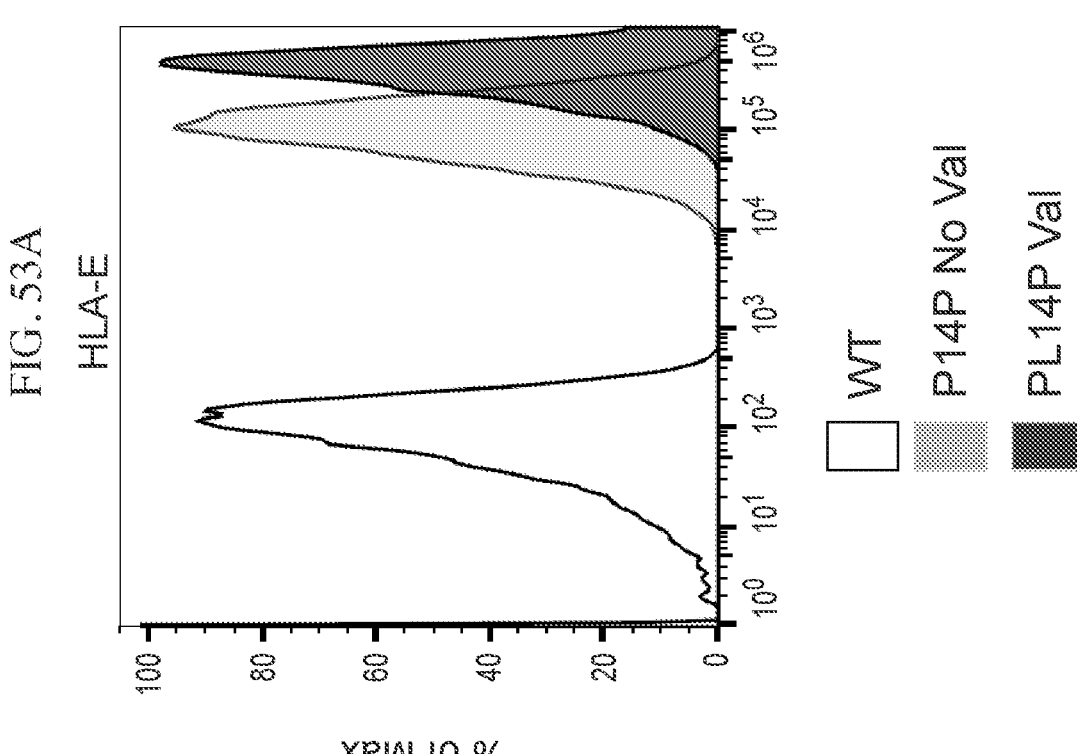

FIG. 53A shows that cells expressing the 14P nucleic acid are protected from NK cell mediated lysis. FIG. 53B shows that cells expressing the 14P and 14S nucleic acids are protected from NK cell mediated lysis in comparison to wild-type (WT) cells or K562 cancer cells that do not express the 14P and 14S nucleic acids.

Figure 54A:
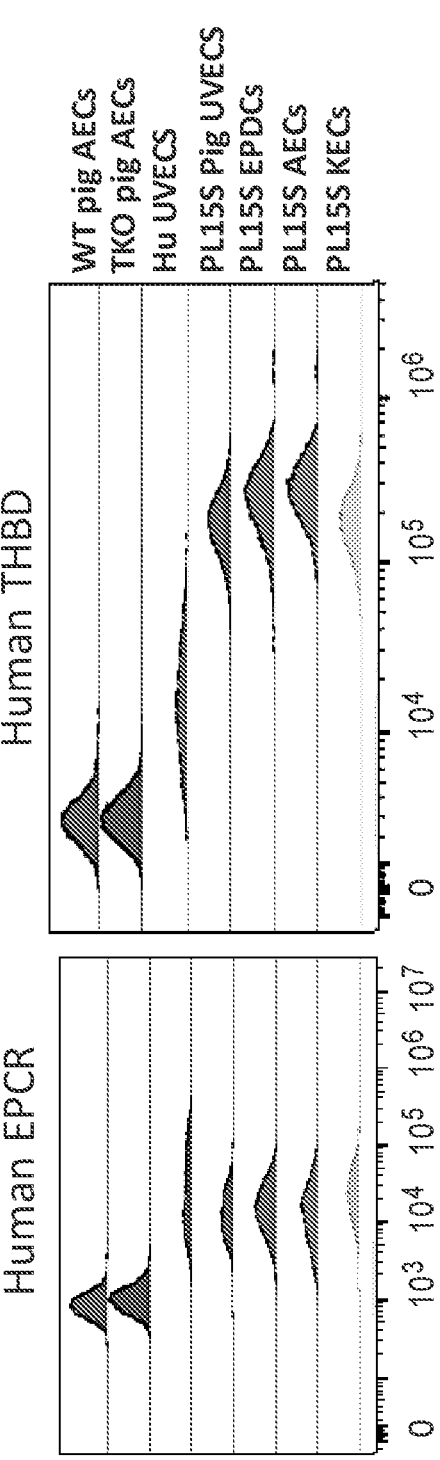
Figure 54B:
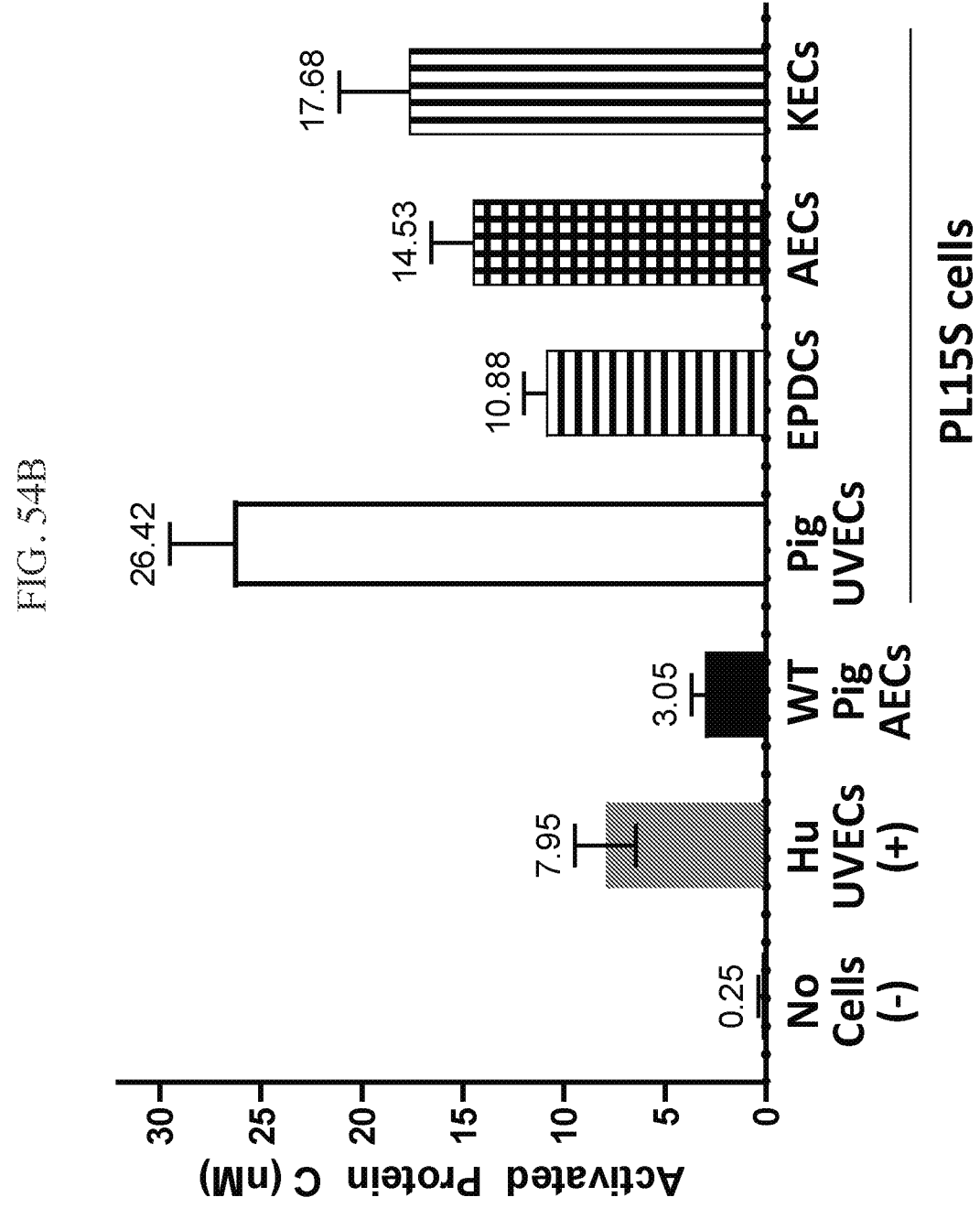

FIG. 54A shows surface expression of human EPCR and THBD proteins on wild type (WT), GGTA1, B4GALNT2, and CMAH triple knock-out (TKO) aortic derived endothelial cells (AECs), human umbilical cord derived endothelial cells (Hu UVECs), and payload 15S porcine endothelial cells derived from the umbilical cord (Pig UVECs), aorta, or kidney (KECs) is shown in the left histogram graph. Payload 15S cells comprise the nucleic acid comprising the polycistronic cassettes of FIG. 2D. FIG. 54B shows that various cells expressing the nucleic acid containing the polycistronic cassettes of FIG. 2D, "15S," have functional THBD and PROCR as indicated by elevated concentrations of activated protein C in comparison to cells that do not express 15S. The following cell types were evaluated: alveolar epithelial cells (AEC), kidney epithelial cells (KEC), human umbilicus vein endothelial cells ("Hu UVECs"), porcine umbilicus vein endothelial cells ("pig UVECs"), and epicardium-derived cells (EPDCs).

Figure 55:
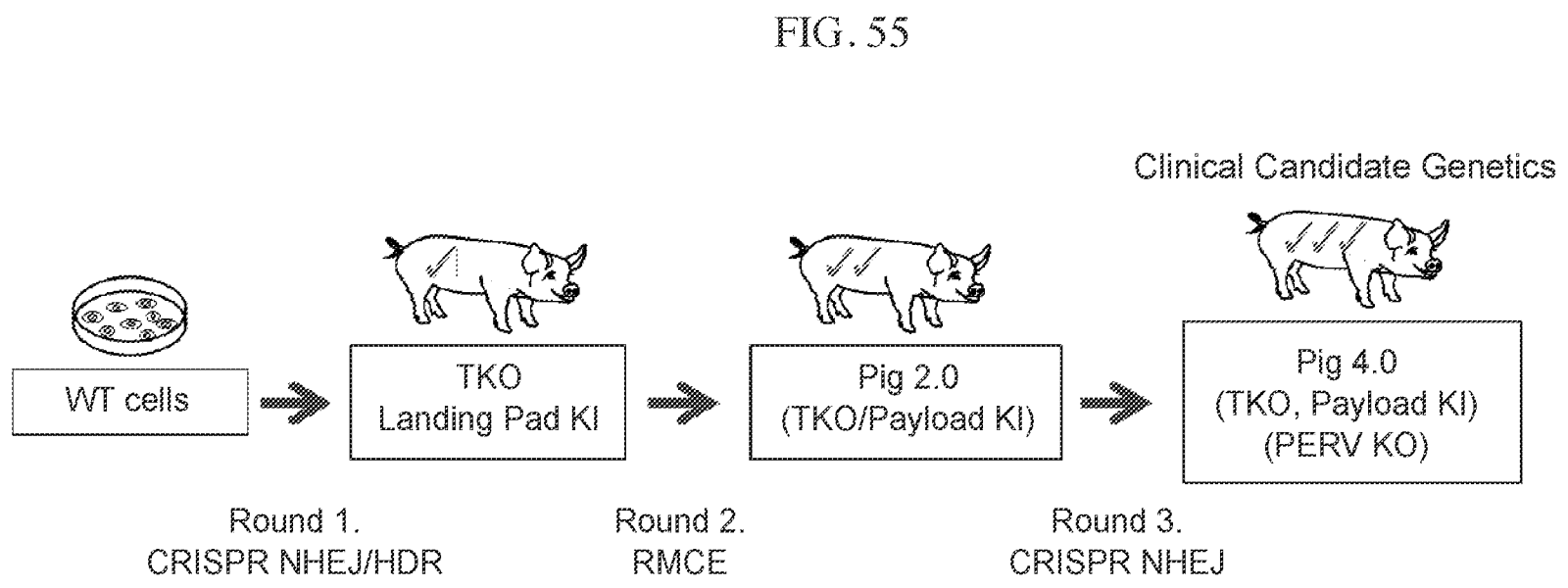

FIG. 55 is a figure illustrating an exemplary method of preparing genetically modified animals comprising the nucleic acids described herein. In a first step (Round 1), CRISPR-Cas9 mediated non-homologous end joining (NHEJ) and homology directed repair is performed to knock out the GGTA1, CMAH, and B4GALNT2 genes (e.g., TKO) from the genome of the cells (e.g., fibroblasts) and introduce a landing pad into the cells at a genomic safe harbor site (e.g., intron 1 of the genomic safe harbor AAVS1 site or into the 3' flanking region of the AAVS1 site). Introduction of the landing pad results in introduction of loxP sites in the genome of the cell. In a second step (Round 2), recombinase mediated cassette exchange is used to introduce nucleic acids comprising polycistronic cassettes (e.g., payload KI). In a third step (round 3), porcine endogenous retroviral elements (PERV) are knocked-out using CRISPR-Cas9 NHEJ.

Figure 56A:
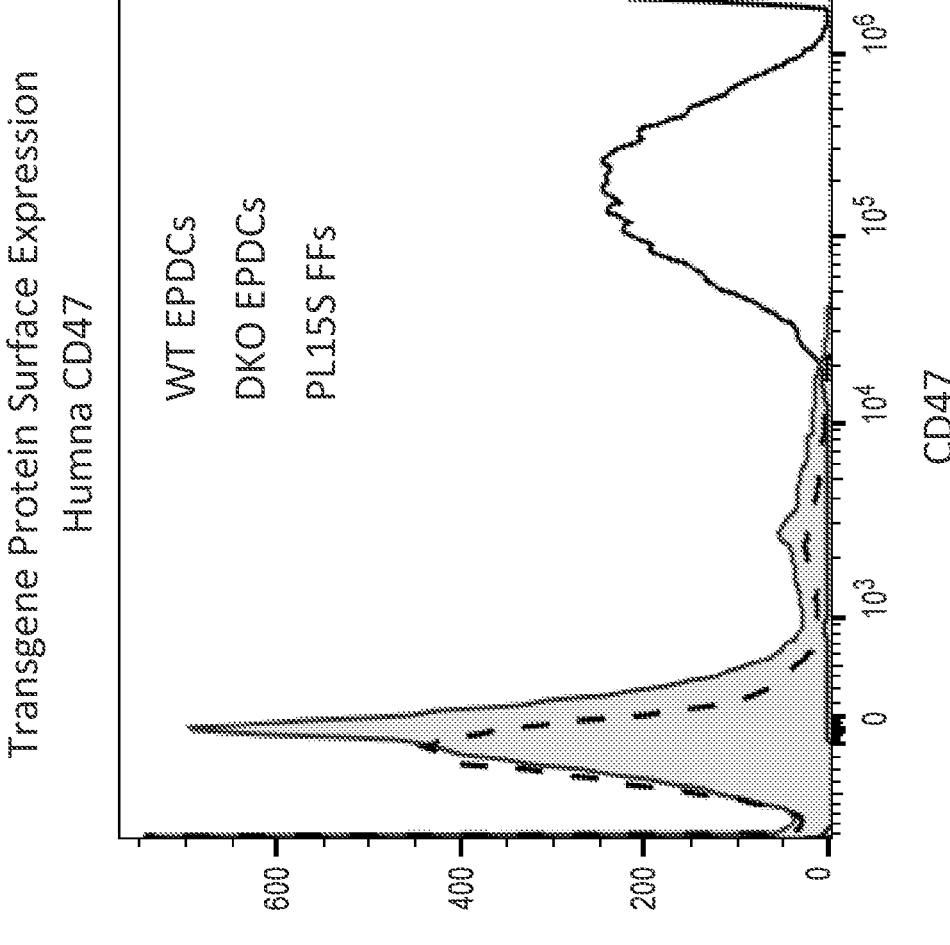
Figure 56B:
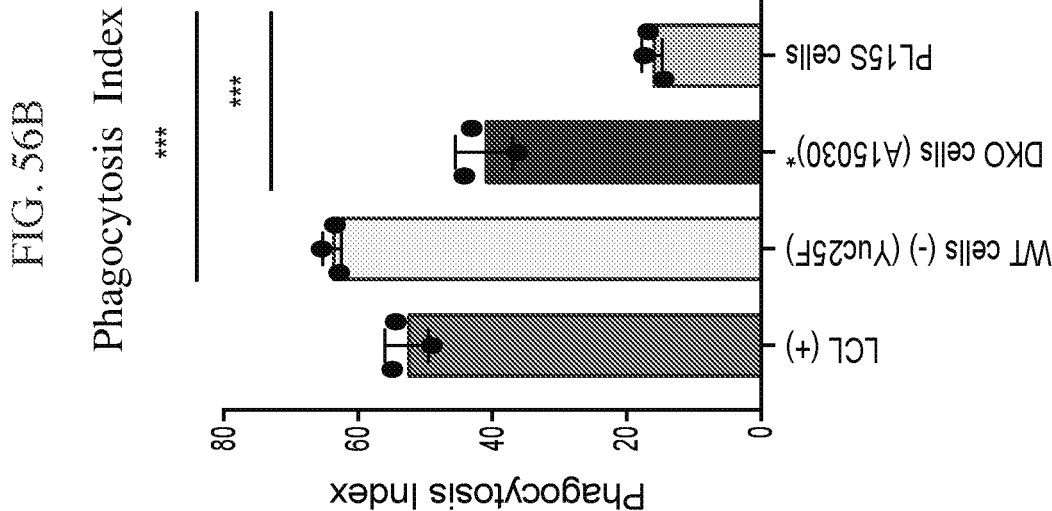
Figure 56C:
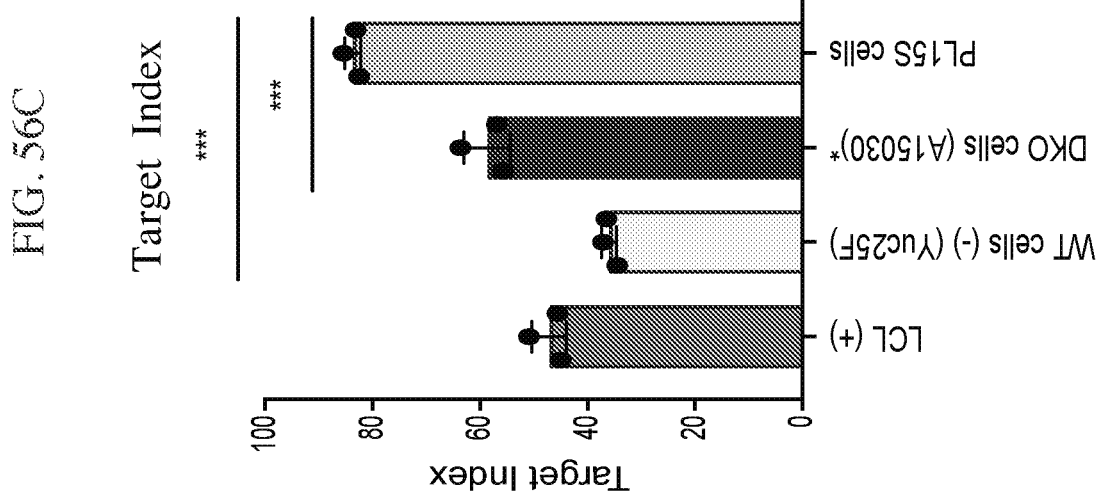

FIG. 56A shows expression of human CD47 protein on wild type (WT) and GGTA1 plus B4GALNT2 double knock-out (DKO) ear punch derived cells (EPDCs), and fetal fibroblasts (FF) derived from PL15S pigs. FIG. 56B shows a reduction in phagocytosis by PL15S pigs. The phagocytosis index is determined by the equation, total phagocytosed signal divided by the sum of the total phago-cytosis signal plus the unphagocytosed signal. FIG. 56C shows that PL15S cells are protected from phagocytosis. PL15S pigs express the polycistronic cassettes of FIG. 2D.

DETAILED DESCRIPTION

I. Definitions

The terms "pig", "swine," and "porcine" are used herein interchangeably to refer to anything related to the various breeds of domestic pig, species *Sus scrofa.*

The term "biologically active" when used to refer to a fragment or derivative of a protein or polypeptide means that the fragment or derivative retains at least one measurable and/or detectable biological activity of the reference full-length protein or polypeptide. For example, a biologically active fragment or derivative of a CRISPR/Cas9 protein may be capable of binding a gRNA, sometimes also referred to herein as a single guide RNA (sgRNA), binding a target DNA sequence when complexed with a guide RNA, and/or cleaving one or more DNA strands.

The terms "treatment," "treating," "alleviation" and the like, when used in the context of a disease, injury or disorder, are used herein to generally mean obtaining a desired pharmacologic and/or physiologic effect, and may also be used to refer to improving, alleviating, and/or decreasing the severity of one or more symptoms of a condition being treated. The effect may be prophylactic in terms of completely or partially delaying the onset or recurrence of a disease, condition, or symptoms thereof, and/or may be therapeutic in terms of a partial or complete cure for a disease or condition and/or adverse effect attrib-utable to the disease or condition. "Treatment" as used herein covers any treatment of a disease or condition of a mammal, particularly a human, and includes: (a) preventing the disease or condition from occurring in a subject which may be predisposed to the disease or condition but has not yet been diagnosed as having it; (b) inhibiting the disease or condition (e.g., arresting its development); or (c) relieving the disease or condition (e.g., causing regression of the disease or condition, providing improvement in one or more symptoms).

The term "simultaneously" is used herein to refer to an event that occurs at the same time as another event, such as within seconds, milliseconds, microseconds, or less when compared to the occurrence of another event.

The term "knockout" ("KO") or "knocking out" is used herein to refer to a deletion, deactivation, or ablation of a gene or deficient gene in a pig or other animal or any cells in the pig or other animal. KO, as used herein, can also refer to a method of performing, or having performed, a deletion, deactivation or ablation of a gene or portion thereof.

The term "knockin" ("KI") or "knocking in" is used herein to refer to an addition, replacement, or mutation of nucleotide(s) of a gene in a pig or other animal or any cells in the pig or other animal. KI, as used herein, can also refer to a method of performing, or having performed, an addi-tion, replacement, or mutation of nucleotide(s) of a gene or portion thereof.

The term "PERV-free" in reference to a porcine tissue, organ, or cell, refers to a tissue, organ, or cell having at least 75% inactive porcine endogenous retroviral (PERV) ele-ments. The PERV element may be a gag, pol, or env gene. In embodiments, a porcine tissue, organ, or cell is at least 75%, at least 80%, at least 85%, at least 90%, at least 95%, at least 97%, at least 98%, at least 99%, or 100% PERV-free.

The term "percent identity" in the context of two or more nucleic acid or polypeptide sequences, refers to two or more sequences or subsequences that have a specified percentage of nucleotides or amino acid residues that are the same, when compared. Percentage identity can be calculated using the tools CLUSTALW2, which are available online. The following parameters may be used for CLUSTALW2 Pair-wise alignment: Protein Weight Matrix=Gonnet; Gap Open=10; Gap Extension=0.1.

The term "conservative substitution" refers to the exchange of one amino acid for another among the follow-ing amino acid groups: (i) the aliphatic amino acids (alanine, valine, leucine, and isoleucine); (ii) amino acids with hydroxyl groups (serine and threonine); (iii) acidic amino acids (glutamic acid and aspartic acid); (iv) amino acids with amide side chains (asparagine and glutamine); (v) basic amino acids (lysine and arginine); (vii) amino acids with aromatic side chains (phenylalanine, tyrosine, and trypto-phan). In embodiments, provided herein are nucleic acid encoding proteins containing conservative substitutions. For example, a protein may have a conservative substitution of alanine with valine. In aspects, the number of amino acid changes to an encoded protein may be 1, 2, 3, 4, 5, 6, 7, 8, 9, or 10 amino acids.

The term "polycistronic cassette" as used herein refers to a nucleic acid comprising two or more "cistrons" or genes under the control of a single promoter and a poly A sequence. The term "polycistronic cassette" is used inter-changeably herein with "transcription unit." In embodi-ments, the polycistronic cassette comprises cDNA. In embodiments, the polycistronic cassette comprises DNA. In embodiments, the polycistronic cassette comprises one or more introns. An exemplary polycistronic cassette is depicted in FIG. 12A. An exemplary nucleic acid compris-ing multiple polycistronic cassettes is depicted in FIG. 12B.

The term "control elements" as used herein refers to nucleic acid sequences that control the expression of a cistron. Exemplary control elements include promoters, enhancers, poly A signals, and terminators. Cistrons whose expression is regulated by control elements are said to be operably controlled by the control elements The term "isolated" as used herein, for example, with respect to nucleic acids or cells refers to a nucleic acid or cell that has been purified such that it has been separate from other components; for example, an isolated nucleic acid may have been purified from a bacterial cells used to produce the nucleic acid or cells may have been isolated from an animal to use for therapeutic purposes.

The term "heterologous" as used herein, refers to regulating expression of a nucleic acid as a result of recombinant DNA manipulation in an organism as opposed to the expression of an endogenous nucleic acid of the host organism. Typically, either the cistron and/or one or more control element regulating expression of the cistron are artificial or derived from a different species than the host organism. In aspects, the cistron and the control elements may be derived from the same species as the host organism but introduced by recombinant approaches that modify control and expression of the cistron compared to the equivalent native cistron.

II. Nucleic Acids Comprising One or More Polycistronic Cassettes

Porcine xenografts are broadly compatible with human organ size and physiology and are ethically acceptable to the US general population. However, xenotransplanted porcine tissue elicits a complex series of events leading to graft rejection including: hyperacute rejection due to the presence of preformed antibodies to pig antigens, complement activation and hypercoagulability, and heightened innate and adaptive immune responses due to molecular incompatibilities. The present disclosure uses genetic engineering approaches to address current shortcomings of xenotransplantation.

The present disclosure provides nucleic acids comprising one or more polycistronic cassettes for genetic engineering of cells, organs, tissues, and animals.

In embodiments, provided herein is a nucleic acid comprising between about 1 and about 10 polycistronic cassettes. For example, the nucleic acid may comprise about 1, about 2, about 3, about 4, about 5, about 6, about 7, about 8, about 9, or about 10 polycistronic cassettes. Each polycistronic cassette comprises two or more cistrons selected from the group of CD46, CD55, CD59, THBD, TFPI, PROCR, CD39, B2M, HLA-E, CD47, A20, PD-L1, HO1, CTLA-4 (e.g., LEA29Y), XIAP, and combinations thereof. In embodiments, the polycistronic cassettes are flanked by insulator sequences, loxP sites, or a combination thereof.

In embodiments, each cistron of a polycistronic cassette is separated by a nucleic acid that encodes a 2A polypeptide or a sequence that comprises an internal ribosome entry site (IRES). In embodiments, 1, 2, 3, 4, or 5 polycistronic cassettes do not contain nucleic acids encoding for 2A polypeptides. Each polycistronic cassette is under the control of a promoter. Exemplary promoters are described in Table B. Each polycistronic cassette also comprises one or more poly A (also referred to as "polyA") and/or terminator sequences. Exemplary poly A sequences and/or terminator sequences are provided in Table C.

When the name of a cistron, promoter, or poly A sequence contains lower case letters before the cistron, promoter, or poly A sequence name, the lower case letters refer to the genus and species the cistron is isolated from. For example, ssA20 refers to A20 from *Sus scrofa*, hsCD46 refers to CD46 from *Homo sapiens*, mmA20 refers to A20 from *Mus musculus*, and btA20 refers to A20 from *Bos taurus*. When the lower case letter "s" is used before the cistron, promoter, or poly A sequence name, s refers to *Sus scrofa*. When the lower case letter "h" is used before the cistron, promoter, or poly A sequence name, h refers to *Homo sapiens*. When the lower case letter "in" is used before the cistron, promoter, or poly A sequence name, M refers to *Mus musculus*.

In embodiments, the nucleic acid sequences of the cistrons are provided in Table A. The NCBI reference sequences, gene IDs, and protein IDs of Table A are incorporated by reference herein. In embodiments, the cistrons are porcine cistrons. In embodiments, the cistrons are human cistrons. In embodiments, the cistrons are mouse cistrons.

TABLE A

| Cistron | Protein encoded by cistron | Synonyms for protein name if applicable | NCBI Gene ID | NCBI Reference Sequence(s): | NCBI Protein ID | SEQ ID NO. |
|---|---|---|---|---|---|---|
| B2M | Beta-2 microglobulin | | 567 | NM_004048 | NP_004039 | |
| HLA-E | Major Histocompatibility Complex, Class 1, E | | 3133 | NM_005516 | NP_005507 | |
| HO1 | heme oxygenase-1 | | 3162, 445512 | NM_002133.3, NM_002133, NM_001004027 | NP 002124, NP 001004027 | 63, 109, 165, 183, 189 |
| A20 | TNF Alpha Induced Protein 3 | | 7128, 100622156 | NM_001270508, NM_001270507.2, NM 001267890 | NP 001257437, NP 001254819 | 64-65, 104, 182, 188 |
| CD39 | cluster of differentiation 39 | | 953 | NM_001776 | NP_001767 | 67-70, 106 |
| CD46 | cluster of differentiation 46 | membrane cofactor protein (MCP) | 4179 | NM_002389.4, NM_153826.4, NM_172351.3, NM_153826.4 | NP_758861, NP_722548 | 71-76, 185, 200, 253-258 (nucleic acid); 262-264 (amino acid) |
| CD47 | cluster of differentiation 47 | | 961 | NM_198793.3, NM_001777.4, NM_198793 | NP_942088 | 77-83, 180, 259 |
| CD55 | cluster of differentiation 55 | Decay-accelerating factor (DAF) | 1604 | NM_000574.5, NM_000574.4 | NP_000565 | 84, 85, 107, 184 |

TABLE A-continued

| Cistron | Protein encoded by cistron | Synonyms for protein name if applicable | NCBI Gene ID | NCBI Reference Sequence(s): | NCBI Protein ID | SEQ ID NO. |
|---|---|---|---|---|---|---|
| CD59 | cluster of differentiation 59 | MAC-inhibitory protein | 966 | NM_203330, NM_000611.6, NM_203330.2 | NP_976075 | 86, 108 |
| CTLA-4 (e.g., LEA29Y) | CTLA-4 | | 1493 | NM_005214 | NP_005205 | 87-88, 186 |
| PD-L1 | programmed cell death 1 ligand 1 | | | NM_014143 | NP_054862 | 89-91 |
| PROCR | endothelial protein c receptor | | 29126 | NM_006404 | NP_006395 | 92-93, 181 |
| TFPI (also called *TFPI) | tissue factor pathway inhibitor | | 7035 | NM_006287, NM_006287 | NP_006278 | 94-96, 103, 187 |
| THBD | thrombomodulin | | 7056 | NM_000361 | NP_000352 | 97-102, 166, 265, 266 |
| XIAP | X-linked inhibitor of apoptosis | | 331 | XM_011531329, NM_001167 | NP_001158 | 110 |
| GFP | Green fluorescent protein | | | | | 111 |
| BFP | Blue fluorescent protein | | | | | 242, 246 |

In embodiments, a polycistronic cassette comprises a nucleic acid encoding a beta-2 microglobulin (B2M) protein. The B2M gene encodes a serum protein found in association with the major histocompatibility complex (MHC) class I heavy chain on the surface of nearly all nucleated cells. In embodiments, a polycistronic cassette comprises a nucleic acid encoding the major histocompatibility complex, class 1, E (HLA-E) protein. The HLA-E protein belongs to the HLA class I heavy chain paralogues. This class I molecule is a heterodimer comprising a heavy chain and a light chain (beta-2 microglobulin). In embodiments, a polycistronic cassette comprises a nucleic acid encoding both B2M and HLA-E proteins. In embodiments, a polycistronic cassette comprises a nucleic acid encoding a fusion of B2M and HLA-E proteins, referred to as a "B2M HLA-E fusion protein". In embodiments, a B2M HLA-E fusion protein is encoded by a nucleic acid sequence that is at least 80%, at least 85%, at least 90%, at least 95%, at least 96%, at least 97%, at least 98%, at least 99%, or 100% identical to a sequence selected from the group consisting of SEQ ID NOS: 62, 66, and 105. In embodiments, the B2M HLA-E fusion protein comprises a peptide epitope. In embodiments, the peptide epitope is encoded by a nucleic acid having the sequence of SEQ ID NO: 260 or SEQ ID NO: 261. A B2M HLA-E fusion protein comprising a peptide epitope is referred to herein as a "single chain trimer." In embodiments, the amino acid sequence of the epitope is VMAPRTLIL (SEQ ID NO: 197) or VMAPRTLFL (SEQ ID NO: 198). In embodiments, the amino acid sequence of the epitope is MAPRTLIL (SEQ ID NO: 251) or MAPRTLFL (SEQ ID NO: 252). In embodiments, the epitope is located at the N-terminus of the B2M-HLA-E fusion protein. Nucleic acids having sequences represented by SEQ ID NOS: 23, 24, 26, 201, 202, and 204 encode a B2M HLA-E fusion protein comprising a peptide epitope with an amino acid sequence represented by SEQ ID NO: 251. Nucleic acids having sequences represented by SEQ ID NOS: 31. 32. 33. 34. 39. 30. 41. 42. 43. 44. 45. 46. 172, 173, 176, 177, 209-212, 216, 217, 219-226, 229, and 230 encode a B2M HLA-E fusion protein comprising a peptide epitope with an amino acid sequence represented by SEQ ID NO: 198. Nucleic acids having sequences represented by SEQ ID NOS: 25, 27-29, 35-37, 40, 203, 205-207, 213-215, and 218 encode a B2M HLA-E fusion protein comprising a peptide epitope with an amino acid sequence represented by SEQ ID NO: 197.

In embodiments, a polycistronic cassette comprises a nucleic acid encoding a heme oxygenase-1 (HO1) protein. HO1 is an essential enzyme in heme catabolism that cleaves heme to form biliverdin, which is subsequently converted to bilirubin by biliverdin reductase, and carbon monoxide, a putative neurotransmitter. Heme oxygenase activity is induced by its substrate heme and by various nonheme substances. In embodiments, the nucleic acid encoding HO1 is isolated from *Sus scrofa*. In embodiments, HO1 is encoded by a nucleic acid that is at least 80%, at least 85%, at least 90%, at least 95%, at least 96%, at least 97%, at least 98%, at least 99%, or 100% identical to a sequence selected from the group consisting of SEQ ID NOS: 63, 109, 165, 183, and 189.

In embodiments, a polycistronic cassette comprises a nucleic acid encoding an A20 protein. The A20 protein is a zinc finger protein and ubiquitin-editing enzyme, and has been shown to inhibit NF-kappa B activation as well as TNF-mediated apoptosis. The A20 protein, which has both ubiquitin ligase and deubiquitinase activities, is involved in the cytokine-mediated immune and inflammatory responses. In embodiments, the nucleic acid encoding an A20 protein is isolated from *Sus scrofa*. In embodiments, the A20 protein is encoded by a nucleic acid having a sequence that is at least 80%, at least 85%, at least 90%, at least 95%, at least 96%, at least 97%, at least 98%, at least 99%, or 100% identical to a sequence selected from the group consisting of SEQ ID NOS: 64-65, 104, 182, and 188.

In embodiments, a polycistronic cassette comprises a nucleic acid encoding a cluster of differentiation 39 (CD39) protein. The protein encoded by this gene is a plasma membrane protein that hydrolyzes extracellular ATP and ADP to AMP. In embodiments, CD39 is encoded by a nucleic acid having a sequence that is at least 80%, at least 85%, at least 90%, at least 95%, at least 96%, at least 97%, at least 98%, at least 99%, or 100% identical to a sequence selected from the group consisting of SEQ ID NOS: 67-70, 106, 253-258, and 262-264.

In embodiments, a polycistronic cassette comprises a nucleic acid encoding a cluster of differentiation 46 (CD46) protein. The protein encoded by this gene is a type I membrane protein and is a regulatory part of the complement system. The encoded protein has cofactor activity for inactivation of complement components C3b and C4b by serum factor I, which protects the host cell from damage by complement. In embodiments, CD46 is encoded by a nucleic acid having a sequence selected that is at least 80%, at least 85%, at least 90%, at least 95%, at least 96%, at least 97%, at least 98%, at least 99%, or 100% identical to a sequence selected from the group consisting of SEQ ID NOS: 71-76 and 185. In embodiments, the CD46 comprises a splice site mutation in which an acceptor-site and donor-site are removed. CD46_LL (SEQ ID NO: 71 or SEQ ID NO: 258 or SEQ ID NO: 254), CD46da1 (SEQ ID NO: 72), CD46da2 (SEQ ID NO: 73), CD46da (SEQ ID NOS: 72, 73, 185, 200, or 256), and CD46i (SEQ ID NOS: 74-75, SEQ ID NO: 255) refer to CD46 proteins with splice site mutations. In embodiments, a polycistronic cassette comprising a gene that encodes a CD46 protein encodes a CD46 isoform selected from CD46 C1, CD46 C2, CD46 BC1, CD46 BC2, and CD46 ABC1. The cistron encoding the CD46 BC1 protein isoform has the nucleic acid sequence of SEQ ID NO: 263. The cistron encoding the CD46 BC2 protein isoform has the nucleic acid sequence of SEQ ID NO: 264. These isoforms are described in the following reference which is incorporated herein in its entirety: *Human Genetics* volume 136, pages 421-435 (2017).

In embodiments, a polycistronic cassette comprises a nucleic acid encoding a cluster of differentiation 47 (CD47) protein. The CD47 protein is a membrane protein, which is involved in the increase in intracellular calcium concentration that occurs upon cell adhesion to extracellular matrix. The CD47 protein is also a receptor for the C-terminal cell binding domain of thrombospondin, and it may play a role in membrane transport and signal transduction. The CD47 protein comprises an IgV domain, a transmembrane domain, and a C-terminal domain. There are four isoforms of the CD47 protein C-terminal domain: isoform 1, isoform 2, isoform 3, and isoform 4. Isoform 1 is 4 amino acids in length and expressed in epithelial and endothelial cells. Isoform 2 is 16 amino acids in length and is the most abundantly expressed isoform of CD47. Isoform 2 is expressed in hematopoietic, endothelial, and epithelial cells. Isoform 3 is 23 amino acids in length, and isoform 4 is 36 amino acids in length. Isoforms 3 and 4 are expressed in neurons, intestines, and testis. In embodiments, CD47 is encoded by a nucleic acid having a sequence that is at least 80%, at least 85%, at least 90%, at least 95%, at least 96%, at least 97%, at least 98%, at least 99%, or 100% identical to a sequence selected from the group consisting of SEQ ID NOS: 77-83, 180, and 259. In embodiments, CD47 is isoform 1, 2, 3, or 4. In embodiments, CD47 is CD47 isoform 2 (CD47-2). In embodiments, CD47-2 is encoded by a nucleic acid having a sequence selected from any one of SEQ ID NOS: 78, 80, 83, and 180. In embodiments, CD47 is CD47 isoform 1 (CD47-1). In embodiments, CD47-1 is encoded by a nucleic acid having a sequence of SEQ ID NO: 259. In embodiments, the polycistronic cassette comprises a nucleic acid encoding a CD47 protein having a S64A mutation, a S79A mutation, or a combination thereof as compared to SEQ ID NO: 201. The following article describes the S64A and S79A mutations and is incorporated by reference herein in its entirety: J Biol Chem. 2011 Apr. 29; 286(17):14991-5002.

In embodiments, a polycistronic cassette comprises a nucleic acid encoding a cluster of differentiation 55 (CD55) protein. This gene encodes a glycoprotein involved in the regulation of the complement cascade. Binding of the encoded protein to complement proteins accelerates their decay, thereby disrupting the cascade and preventing damage to host cells. In embodiments, CD55 protein is encoded by a nucleic acid having a sequence that is at least 80%, at least 85%, at least 90%, at least 95%, at least 96%, at least 97%, at least 98%, at least 99%, or 100% identical to a sequence selected from the group consisting of SEQ ID NOS: 84, 85, 107, and 184.

In embodiments, a polycistronic cassette comprises a nucleic acid encoding a cluster of differentiation 59 (CD59) protein. CD59 protein is a cell surface glycoprotein that regulates complement-mediated cell lysis, and it is involved in lymphocyte signal transduction. The CD59 protein is a potent inhibitor of the complement membrane attack complex, whereby it binds complement C8 and/or C9 during the assembly of this complex, thereby inhibiting the incorporation of multiple copies of C9 into the complex, which is necessary for osmolytic pore formation. In embodiments, CD59 is encoded by a nucleic acid having a sequence that is at least 80%, at least 85%, at least 90%, at least 95%, at least 96%, at least 97%, at least 98%, at least 99%, or 100% identical to a sequence selected from the group consisting of SEQ ID NO: 86 and SEQ ID NO: 108.

In embodiments, a polycistronic cassette comprises a nucleic acid encoding a CTLA-4 protein. In embodiments, the nucleic acid encodes the extracellular domain of the CTLA-4 protein. In embodiments, the extracellular domain of the CTLA-4 protein comprises an L104E mutation, an A29Y mutation, or both relative to SEQ ID NO: 199. In embodiments, the nucleic acid encoding CTLA-4 comprises a nucleic acid encoding an immunoglobulin or a fragment thereof. In embodiments, the fragment thereof of an immunoglobulin is a kappa light chain or a lambda light chain. In embodiments, the fragment thereof is an immunoglobulin heavy chain. In embodiments, the fragment thereof is a CH1, CH2, CH3, or CH4 domain of an immunoglobulin heavy chain. In embodiments, the fragment thereof is the variable heavy or variable light domain of an immunoglobulin. In embodiments, the nucleic acid encoding a CLTA-4 protein or a fragment thereof and an immunoglobulin or fragment thereof is LEA29Y. In embodiments, the nucleic acid encoding a CTLA-4 protein or a fragment thereof and an immunoglobulin or fragment thereof comprises the extracellular domain of the CTLA-4 (SEQ ID NO: 199) protein with an L104E mutation and an A29Y mutation relative to SEQ ID NO: 199 and the hinge, CH2, and CH3 domains of human immunoglobulin 1. The nucleic acid sequence of LEA29Y encodes a protein having the following amino acid sequence: MHVAQPAVVLASSRGIASFVC-EYASPGKYTEVRVTVLRQADSQVTEVCAATYMMG NELTFLDDSICTGTSSGNQVNLTIQGLRAMDTG-LYICKVELMYPPPYYEGIGNGTQIY VID-PEPCPDSDQEPKSSDKTHTSPPSPA-PELLGGSSVFLFPPKPKDTLMISRTPEVTCVV VDVSHEDPEVKFNWYVDGVEVHNAKTKPREEQYN-STYRVVSVLTVLHQDWLNGK EYKCKVSNKALPA-PIEKTISKAKGQPREPQVYTLPPSRDELTKNQVSLT-CLVKGFYPS DIAVEWESNGQPENNYKTTPPVLDSDGSFFLYSK-
LTVDKSRWQQGNVFSCSVMHEA LHNHYTQKSLSL-
SPGK (SEQ ID NO: 196). LEA29Y binds human B7.1/
CD80 and B7.2/CD86 with high affinity and is thus a potent
inhibitor of T cell co-stimulation via this pathway. The
following references describe LEA29Y and are incorporated
by reference herein in their entirety: International Publica-
tion No. 2001/092337 and Wolf-van Buerck et al. Scientific
Reports. 7: 3572 (2017). In embodiments, the CTLA-4
protein is encoded by a nucleic acid having a sequence that
is at least 80%, at least 85%, at least 90%, at least 95%, at
least 96%, at least 97%, at least 98%, at least 99%, or 100%
identical to a sequence selected from the group consisting of
SEQ ID NO: 87, SEQ ID NO: 88, and SEQ ID NO: 186.

In embodiments, a polycistronic cassette comprises a
nucleic acid that encodes a programmed cell death 1 ligand
1 (PD-L1) protein. The PD-L1 protein is an immune inhibi-
tory receptor ligand that is expressed by hematopoietic and
non-hematopoietic cells, such as T cells and B cells and
various types of tumor cells. The PD-L1 protein is a type I
transmembrane protein that has immunoglobulin V-like and
C-like domains. Interaction of this ligand with its receptor
inhibits T-cell activation and cytokine production. In
embodiments, the PD-L1 protein is encoded by a nucleic
acid having at least 80%, at least 85%, at least 90%, at least
95%, at least 96%, at least 97%, at least 98%, at least 99%,
or 100% identity to sequence selected from the group
consisting of SEQ ID NOS: 89-91.

In embodiments, a polycistronic cassette comprises a
nucleic acid encoding an endothelial protein c receptor
(EPCR) protein. The gene that encodes for EPCR is referred
to as PROCR. EPCR binds activated protein C. In embodi-
ments, EPCR is encoded by a nucleic acid having at least
80%, at least 85%, at least 90%, at least 95%, at least 96%,
at least 97% at least 98%, at least 99%, or 100% identity to
sequence selected from the group consisting of SEQ ID
NOS: 92, 93, and 181.

In embodiments, a polycistronic cassette comprises a
nucleic acid encoding for a tissue factor pathway inhibitor
(TFPI) protein. The protein encoded by TFPI inhibits factor
X, and inhibits VIIa/tissue factor activity. In embodiments,
TFPI is encoded by a nucleic acid having at least 80%, at
least 85%, at least 90%, at least 95%, at least 96%, at least
97%, at least 98%, at least 99%, or 100% identity to
sequence selected from the group consisting of SEQ ID
NOS: 94-96, 103, and 187. In embodiments, TFPI is a fusion
between TFPI, a CD4 transmembrane domain
(NM_000616) or a fragment thereof, and a P-selectin cyto-
solic tail (NM_003005) or a fragment thereof. In embodi-
ments, TFPI lacks the P-selectin tail portion and is referred
to herein as TFPI (ΔP-Sel). In embodiments, the CD4
transmembrane domain comprises amino acids 166 to 435 of
CD4 with an NCBI RefSeq ID of NM_000616. In embodi-
ments, the P-selectin cytosolic tail comprises amino acids
797 to 830 of a P-selectin with an NCBI RefSeq ID of
NM_003005.

In embodiments, a polycistronic cassette comprises a
nucleic acid encoding a thrombomodulin (THBD) protein.
The THBD protein is an endothelial-specific type I mem-
brane receptor that binds thrombin. This binding results in
the activation of protein C, which degrades clotting factors
Va and VIIIa and reduces the amount of thrombin generated.
In embodiments, the THBD protein is encoded by a nucleic
acid having at least 80%, at least 85%, at least 90%, at least
95%, at least 96%, at least 97%, at least 98%, at least 99%,
or 100% identity to sequence selected from the group
consisting of SEQ ID NOS: 97-102, 166, 265-266. In embodiments, the gene encoding the THBD protein is
"THBDda." THBDda is a cistron encoding for THBD that
contains a splice site mutation. In embodiments, the
THBDda cistron has a sequence that is at least 80%, at least
85%, at least 90%, at least 95%, at least 96%, at least 97%,
at least 98%, at least 99%, or 100% identical to a sequence
selected from of the group consisting of SEQ ID NOS.
99-102, 166, and 266.

In embodiments, a polycistronic cassette comprises a
nucleic acid encoding a X-linked inhibitor of apoptosis
(XIAP) protein. In embodiments, XIAP is encoded by a
nucleic acid having at least 80%, at least 85%, at least 90%,
at least 95%, at least 96%, at least 97% at least 98%, at least
99%, or 100% identity to a sequence of SEQ ID NO: 110.
This gene encodes a protein that belongs to a family of
apoptotic suppressor proteins.

In embodiments, any cistron described herein comprises
a start codon or a stop codon. The polycistronic cassettes are
organized such that transcription proceeds from the 5' prime
end of the cassette through to the 3' end to facilitate
expression of each cistron. An individual cistron may have
a start codon or a stop codon added or removed to facilitate
the expression of the polycistron.

In embodiments, a polycistronic cassette comprises two
or more cistrons that share a function, for example, genes
that participate in complement regulation, coagulation,
innate immunity, inflammation and apoptosis, and cell
immunity. In embodiments, a polycistronic cassette com-
prises two or more cistrons that have different functions.

In embodiments, the nucleic acids described herein com-
prise one or more polycistronic cassettes selected from the
group consisting of a coagulation cassette, a complement
regulation cassette, a complement regulation and inflamma-
tion and apoptosis cassette, an innate immunity cassette, an
innate immunity and inflammation and apoptosis cassette,
an inflammation and apoptosis cassette, a complement regu-
lation and innate immunity cassette, a cell immunity and
coagulation cassette, an apoptosis and coagulation cassette,
and an apoptosis and cell immunity cassette.

In embodiments, a coagulation cassette comprises one or
more cistrons selected from the group consisting of THBD,
TFPI, CD39, and PROCR. In embodiments, a coagulation
cassette comprises one or more cistrons selected from
THBD and TFPI. In embodiments, a coagulation cassette
comprises one or more cistrons selected from THBD, TFPI,
and CD39. In embodiments, a coagulation cassette com-
prises one or more cistrons selected from PROCR and
THBD. In embodiments, a coagulation cassette comprises
one or more cistrons selected from TFPI, PROCR, and
THBD.

In embodiments, a complement regulation cassette com-
prises one or more cistrons selected from the group consist-
ing of CD46, C59, and CD55. In embodiments, a comple-
ment regulation cassette comprises one or more cistrons
selected from CD46 and CD59. In embodiments, a comple-
ment regulation cassette comprises one or more cistrons
selected from CD46 and CD55. In embodiments, a comple-
ment regulation cassette comprises one or more cistrons
selected from CD46, CD55, and CD59. In embodiments, a
complement regulation cassette comprises one or more
cistrons selected from CD55 and CD59. In embodiments,
nucleic acids comprising a complement regulation cassette
prevent complement deposition. For example, FIG. 18D
shows that expression of nucleic acids comprising the cis-
trons CD46, CD55, CD59, or a combination thereof reduce deposition of complement protein C3b compared to expression of nucleic acids lacking the cistrons CD46, CD55, and CD59.

In embodiments, a complement regulation and inflammation and apoptosis cassette comprises one or more cistrons selected from the group consisting of CD46, CD55, CD59, A20, HO1, and PD-L1. In embodiments, a complement regulation and inflammation and apoptosis cassette comprises one or more cistrons selected from CD46, CD55, CD59, A20, HO1, and PD-L1. In embodiments, a complement regulation and inflammation and apoptosis cassette comprises one or more cistrons selected from CD46, CD55, A20, and HO1.

In embodiments, an innate immunity cassette comprises one or more cistrons selected from the group consisting of B2M, HLA-E, a B2M HLA-E fusion protein, CD47, and combinations thereof. In embodiments, an innate immunity cassette comprises a cistron encoding a B2M HLA-E fusion protein and a CD47 cistron.

In embodiments, an innate immunity and inflammation and apoptosis cassette comprises one or more cistrons selected from the group consisting of B2M, HLA-E, a B2M HLA-E fusion protein, CD47, A20, HOT, PD-L1, and combinations thereof. In embodiments, an innate immunity and inflammation and apoptosis cassette comprises one or more of a B2M cistron, a HLA-E cistron, a cistron encoding a B2M HLA-E fusion protein, a CD47 cistron, an A20 cistron, a HO1 cistron, and a PD-L1 cistron. In embodiments, an innate immunity and inflammation and apoptosis cassette comprises one or more cistrons selected from B2M, HLA-E, a B2M HLA-E fusion protein, CD47, A20, and HOT. In embodiments, an innate immunity and inflammation and apoptosis cassette comprises one or more cistrons selected from a cistron encoding a B2M HLA-E fusion protein, CD47, A20, and HOT.

In embodiments, an inflammation and apoptosis cassette comprises one or more cistrons selected from the group consisting of A20, HO1, and PD-L1. In embodiments, an inflammation and apoptosis cassette comprises one or more cistrons selected from A20 and HO1. In embodiments, an inflammation and apoptosis cassette comprises one or more cistrons selected from A20 and PD-L1.

In embodiments, a complement regulation and innate immunity cassette comprises one or more cistrons selected from the group consisting of CD46, CD55, CD47, B2M, HLA-E, a B2M HLA-E fusion protein, and combinations thereof. In embodiments, a complement regulation and innate immunity cassette comprises one or more cistrons selected from CD46, CD55, and CD47.

In embodiments, a cell immunity and coagulation cassette comprises one or more cistrons selected from the group consisting of LEA29Y, CD39, TFPI, THBD, and PROCR. In embodiments, a cell immunity and coagulation cassette comprises a CTLA-4 (e.g., LEA29Y) cistron and a CD39 cistron.

In embodiments, an apoptosis and coagulation cassette comprises one or more cistrons selected from the group consisting of THBD, TFPI, CD39, PROCR, and XIAP. In embodiments, an apoptosis and coagulation cassette comprises a XIAP cistron and a CD39 cistron.

In embodiments, an apoptosis and cell immunity cassette comprises one or more cistrons selected from the group consisting of A20, PD-L1, HO1, and CTLA-4 (e.g., LEA29Y). In embodiments, an apoptosis and cell immunity cassette comprises A20 and CTLA-4 (e.g., LEA29Y) cistrons. In embodiments, an apoptosis and cell immunity cassette comprises A20 and HO1 cistrons. In embodiments, the A20 cistron, HO1 cistron, or both are from *Sus scrofa*.

In embodiments, a coagulation and innate immunity cassette comprises one or more cistrons selected from the group consisting of a THBD cistron, a TFPI cistron, a CD39 cistron, a PROCR cistron, a B2M cistron, a HLA-E cistron, a cistron encoding a B2M HLA-E fusion protein, and a CD47 cistron. In embodiments, a coagulation and innate immunity cassette comprises a THBD cistron, a CD47 cistron, and a PROCR cistron.

In embodiments, a nucleic acid comprises a first polycistronic cassette, a second polycistronic cassette, and a third polycistronic cassette, wherein the first polycistronic cassette is located 5' to the second polycistronic cassette, and the second polycistronic cassette is located 5' to the third polycistronic cassette. In embodiments, a coagulation cassette is the first, second, or third polycistronic cassette. In embodiments, a complement regulation cassette is the first, second, or third polycistronic cassette. In embodiments, a complement regulation and inflammation and apoptosis cassette is the first, second, or third polycistronic cassette. In embodiments, an innate immunity cassette is the first, second, or third polycistronic cassette. In embodiments, an innate immunity and inflammation and apoptosis cassette is the first, second, or third polycistronic cassette. In embodiments, an inflammation and apoptosis cassette is the first, second, or third polycistronic cassette. In embodiments, a complement regulation and innate immunity cassette is the first, second, or third polycistronic cassette. In embodiments, a cell immunity and coagulation cassette is the first, second, or third polycistronic cassette. In embodiments, an apoptosis and coagulation cassette is the first, second, or third polycistronic cassette. In embodiments, an apoptosis and cell immunity cassette is the first, second, or third polycistronic cassette. In embodiments, a coagulation and innate immunity cassette is the first, second, or third polycistronic cassette.

In embodiments, a nucleic acid comprises a first polycistronic cassette, a second polycistronic cassette, a third polycistronic cassette, and a fourth polycistronic cassette, wherein the first polycistronic cassette is located 5' to the second polycistronic cassette, the second polycistronic cassette is located 5' to the third polycistronic cassette, and the third polycistronic cassette is located 5' to the fourth polycistronic cassette. In embodiments, a coagulation cassette is the first, second, third, or fourth polycistronic cassette. In embodiments, a complement regulation cassette is the first, second, third, or fourth polycistronic cassette. In embodiments, a complement regulation and inflammation and apoptosis cassette is the first, second, third, or fourth polycistronic cassette. In embodiments, an innate immunity cassette is the first, second, third, or fourth polycistronic cassette. In embodiments, an innate immunity and inflammation and apoptosis cassette is the first, second, third, or fourth polycistronic cassette. In embodiments, an inflammation and apoptosis cassette is the first, second, third, or fourth polycistronic cassette. In embodiments, a complement regulation and innate immunity cassette is the first, second, third, or fourth polycistronic cassette. In embodiments, a cell immunity and coagulation cassette is the first, second, third, or fourth polycistronic cassette. In embodiments, an apoptosis and coagulation cassette is the first, second, third, or fourth polycistronic cassette. In embodiments, an apoptosis and cell immunity cassette is the first, second, third, or fourth polycistronic cassette. In embodiments, a coagulation and innate immunity cassette is the first, second, third, or fourth polycistronic cassette.

In embodiments, a nucleic acid comprising multiple polycistronic cassettes comprises a coagulation cassette, a complement regulation cassette, and an innate immunity cassette. In embodiments, the coagulation cassette is located 5' to the complement regulation cassette. In embodiments, the complement regulation cassette is located 5' to the innate immunity cassette. In embodiments, the coagulation cassette is located 5' to the complement regulation cassette, and the complement regulation cassette is located 5' to the innate immunity cassette. In embodiments, the coagulation cassette is located 5' to the innate immunity cassette, and the innate immunity cassette is located 5' to the complement regulation cassette. In embodiments, the innate immunity cassette is located 5' to the coagulation cassette, and the coagulation cassette is located 5' to the complement regulation cassette.

In embodiments, a nucleic acid comprising multiple polycistronic cassettes comprises a coagulation cassette, a complement regulation cassette, and an innate immunity and inflammation and apoptosis cassette. In embodiments, the coagulation cassette is located 5' to the complement regulation cassette, and the complement regulation cassette is located 5' to the innate immunity and apoptosis cassette. In embodiments, the complement regulation cassette is located 5' to the innate immunity and apoptosis cassette. In embodiments, the coagulation cassette is located 5' to the complement regulation cassette.

In embodiments, a nucleic acid comprising multiple polycistronic cassettes comprises a coagulation cassette, an inflammation and apoptosis cassette, and a complement regulation and innate immunity cassette. In embodiments, a coagulation cassette is located 5' to the inflammation and apoptosis cassette, and the inflammation and apoptosis cassette is located 5' to the complement regulation and innate immunity cassette. In embodiments, a coagulation cassette is located 5' to the inflammation and apoptosis cassette. In embodiments, the inflammation and apoptosis cassette is located 5' to the complement regulation and innate immunity cassette.

In embodiments, a nucleic acid comprising multiple polycistronic cassettes comprises a coagulation cassette, a complement regulation and inflammation and apoptosis cassette, and an innate immunity cassette. In embodiments, the innate immunity is located 5' to the coagulation cassette, and the coagulation cassette is located 5' to the complement regulation and inflammation and apoptosis cassette.

In embodiments, a nucleic acid comprising multiple polycistronic cassettes comprises a coagulation cassette, a complement regulation cassette, an innate immunity cassette, and a cell immunity and coagulation cassette. In embodiments, the coagulation cassette is located 5' to the innate immunity cassette. In embodiments, the innate immunity cassette is located 5' to the cell immunity and coagulation cassette. In embodiments, the cell immunity and coagulation cassette is located 5' to the complement regulation cassette. In embodiments, the coagulation cassette is located 5' to the innate immunity cassette, the innate immunity cassette is located 5' to the cell immunity and coagulation cassette, and the cell immunity and coagulation cassette is located 5' to the complement regulation cassette.

In embodiments, the nucleic acid comprising multiple polycistronic cassettes comprises a coagulation cassette, a complement regulation cassette, an innate immunity cassette, and an apoptosis and inflammation cassette. In embodiments, the coagulation cassette is located 5' to the innate immunity cassette, the innate immunity cassette is located 5' to the apoptosis and inflammation cassette, and the apoptosis and inflammation cassette is located 5' to the complement regulation cassette. In embodiments, the coagulation cassette is located 5' to the innate immunity cassette, the innate immunity cassette is located 5' to the complement regulation cassette, and the complement regulation cassette is located 5' to the apoptosis and inflammation cassette.

In embodiments, the nucleic acid comprising multiple polycistronic cassettes comprises a coagulation cassette, a complement regulation cassette, an innate immunity cassette, and an apoptosis and coagulation cassette. In embodiments, the coagulation cassette is located 5' to the innate immunity cassette, the innate immunity cassette is located 5' to the apoptosis and coagulation cassette, and the cell immunity and coagulation cassette is located 5' to the complement regulation cassette.

In embodiments, the nucleic acid comprising multiple polycistronic cassettes comprises a coagulation cassette, a complement regulation cassette, an innate immunity cassette, and an apoptosis and cell immunity cassette. In embodiments, the coagulation cassette is located 5' to the innate immunity cassette, the innate immunity cassette is located 5' to the apoptosis and cell immunity cassette, and the apoptosis and cell immunity cassette is located 5' to the complement regulation cassette.

In embodiments, the nucleic acid comprising multiple polycistronic cassettes comprises a coagulation and innate immunity cassette, an apoptosis and cell immunity cassette, and a complement regulation cassette. In embodiments, the coagulation and innate immunity cassette is located 5' to the apoptosis and cell immunity cassette, and the apoptosis and cell immunity cassette is located 5' of the complement regulation cassette.

In embodiments, the nucleic acid comprising at least one polycistronic cassettes comprises one or more promoters, for example, about 1, 2, 3, 4, 5, 6, 7, 8, 9, 10, 11, 12, 13, 14, 15, 16, 17, or 18 promoters. In embodiments, the nucleic acid comprising at least one polycistronic cassettes contains a different promoter for each polycistronic cassette. A promoter is a DNA sequence that defines where transcription of a polycistronic cassette by RNA polymerase begins. In embodiments, the promoter is derived from a porcine gene. In embodiments, the promoter is derived from a mouse gene. In embodiments, the promoter is derived from a human gene. In embodiments, the promoter is an eukaryotic translation elongation factor 1 alpha 1 (abbreviated "EF1α1" or "EEF1α1") promoter. EF1α1 promoters are constitutive promoters. In embodiments, the promoter is a CAG promoter. The CAG promoter comprises the cytomegalovirus enhancer fused to the chicken beta-actin promoter and the splice acceptor of the rabbit beta-globin gene. In embodiments, the promoter is an actin gamma 1 (ACTGT) promoter. In embodiments, the promoter is a heat shock protein family A member 8 (HSPA8) promoter. In embodiments, the promoter is an ubiquitin C (UBC) promoter. In embodiments, the promoter is an intracellular adhesion molecule 2 (ICAM2) promoter. In embodiments, the promoter comprises an EF1α1, CAG, ACTG1, HSPA8, UBC, or ICAM2 promoter. In embodiments, the promoter comprises an extension at the 5' or 3' end. In embodiments, the extension is an intron or a fragment thereof. The intron may be inherited from the endogenous promoter gene (e.g., EF1α1, CAG, ACTG1, HSPA8, UBC, or ICAM2) or provided from another source.

In embodiments, a promoter comprises a CpG island. CpG islands are regions with elevated GC content and a high density of CpG dinucleotides. In embodiments, a CpG island is located 5' of a promoter's exon sequence. In embodiments, a CpG island comprises a GC content of at least 50%, at least 55%, at least 60%, at least 65%, at least 70%, at least 75%, at least 80%, at least 85%, at least 90%, or at least 95%. In embodiments, a CpG island comprises about 500 base pairs (bp) to about 3 kilobase pairs (kb). In embodiments, a CpG island comprises about 500 bp to about 5 kb. In embodiments, a CpG island comprises about 1 kb to about 3 kb. For example, a CpG island may comprise at least about 500 bp, at least about 1 kb, at least about 1.5 kb, at least about 2 kb, at least about 2.5 kb, at least about 3 kb, at least about 3.5 kb, at least about 4 kb, at least about 4.5 kb, or at least about 5 kb. In contrast, standard promoters are about 100-200 base pairs in length. In embodiments, CpG islands contain a ratio of observed to expected number of CpG dinucleotides of greater than 0.60. In embodiments, a CpG island comprises an unmethylated CpG dinucleotide. In embodiments, a CpG island comprises a methylated CpG dinucleotide. The following references describe CpG islands: J Mol Bio. 1987 Jul. 20; 196(2):261-82; Nat Rev Mol Cell Biol. 2018 October; 19(10): 621-637; Biochem Biophys Res Commun. 2009 May 15; 382(4): 643-645. Each of these references is incorporated herein in its entirety.

Non-limiting examples of promoters comprised within the nucleic acids or polycistronic cassettes described herein are shown in Table B. In embodiments, the promoter comprises a nucleic acid sequence having at least 80%, at least 85%, at least 90%, at least 95%, at least 96%, at least 97%, at least 98%, at least 99%, or 100% identity to a sequence selected from the group consisting of SEQ ID NOS: 126-145, 167, 168, 178, 179, 231-238, 247 and 250.

TABLE B

| Name | SEQ ID NO. |
|---|---|
| CAG | 126-128, 247, 250 |
| hsACTG1 | 129 |
| hsEF1α1, also called "hEF1α1" | 130-132, 231-232 |
| hsHSPA8 | 133 |
| mmEF1α1, also called "mEF1a1" | 134-135 |
| ssEEF1α1, also called "ssEEF1A1(ATACseq)" | 136-138, 179, 233-235 |
| ssHSPA8, also called "ssHSPA8 (ATACseq)" | 139-140, 142-145, 236-238 |
| ssUBC | 141, 168, 178 |
| ssICAM2 | 167 |

In embodiments, each promoter within the nucleic acid is distinct. In embodiments, a first promoter and a second promoter within the nucleic acid are the same. In embodiments, each polycistronic cassette of a nucleic acid comprises a different promoter. In embodiments, a promoter is a forward promoter, which is located on the sense strand. In embodiments, a promoter is a reverse promoter, which is located on the antisense strand.

Forward promoters are denoted with a forward arrow in FIGS. 1A-D, 2A-J, 3A-3C, 4A-4H, 5A-5F, and 6 while reverse promoters are denoted with a reverse arrow.

In embodiments, any of the cassettes described herein may comprise any promoter from Table B. Exemplary arrangements of promoters and polycistronic cassettes are found in FIGS. 1A-D, 2A-J, 3A-3C, 4A-4H, 5A-5F, and 6.

In embodiments, provided herein is a nucleic acid containing from 5' to 3' a first polycistronic cassette, a second polycistronic cassette, and a third polycistronic cassette. In embodiments, the first polycistronic cassette and second polycistronic cassette are under the control of promoters that initiate cassette transcription on different strands. For example, the first polycistronic cassette may comprise a forward promoter and the second polycistronic cassette may comprise a reverse promoter. Alternatively, the first polycistronic cassette may comprise a reverse promoter and the second polycistronic cassette may comprise a forward promoter. In embodiments, the second polycistronic cassette and third polycistronic cassette are under the control of promoters that initiate cassette transcription on different strands. For example, the second polycistronic cassette may comprise a forward promoter and the third polycistronic cassette may comprise a reverse promoter. Alternatively, the second polycistronic cassette may comprise a reverse promoter and the third polycistronic cassette may comprise a forward promoter. In embodiments, the first polycistronic cassette is under the control of a forward promoter, the second polycistronic cassette is under the control of a reverse promoter, and the third polycistronic cassette is under the control of a forward promoter. In embodiments, the first polycistronic cassette is under the control of a reverse promoter, the second polycistronic cassette is under the control of a forward promoter, and the third polycistronic cassette is under the control of a reverse promoter.

In embodiments, provided herein is a nucleic acid containing from 5' to 3' a first polycistronic cassette, a second polycistronic cassette, a third polycistronic cassette, and a fourth polycistronic cassette. In embodiments, the first polycistronic cassette and second polycistronic cassette are under the control of promoters that initiate cassette transcription on different strands. For example, the first polycistronic cassette may comprise a forward promoter and the second polycistronic cassette may comprise a reverse promoter. Alternatively, the first polycistronic cassette may comprise a reverse promoter and the second polycistronic cassette may comprise a forward promoter. In embodiments, the second polycistronic cassette and third polycistronic cassette are under the control of promoters that initiate cassette transcription on different strands. For example, the second polycistronic cassette may comprise a forward promoter and the third polycistronic cassette may comprise a reverse promoter. Alternatively, the second polycistronic cassette may comprise a reverse promoter and the third polycistronic cassette may comprise a forward promoter. In embodiments, the third polycistronic cassette and fourth polycistronic cassette are under the control of promoters that initiate cassette transcription on different strands. For example, the third polycistronic cassette may comprise a forward promoter and the fourth polycistronic cassette may comprise a reverse promoter. Alternatively, the third polycistronic cassette may comprise a reverse promoter and the fourth polycistronic cassette may comprise a forward promoter. In embodiments, the first polycistronic cassette is under the control of a reverse promoter, the second polycistronic cassette is under the control of a forward promoter, the third polycistronic cassette is under the control of a reverse promoter, and the fourth polycistronic cassette is under the control of a forward promoter. In embodiments, the first polycistronic cassette is under the control of a forward promoter, the second polycistronic cassette is under the control of a reverse promoter, the third polycistronic cassette is under the control of a forward promoter, and the fourth polycistronic cassette is under the control of a reverse promoter.

In embodiments, the nucleic acid comprising at least one polycistronic cassette comprises one or more poly A sequences. In embodiments, the poly A sequence is from a human growth hormone (GH) gene. In embodiments, the poly A sequence is from a beta globin (HBB) gene. In embodiments, a poly A is from a SV40 virus. In embodiments, a poly A sequence is synthetic poly A (pA). Exemplary poly A sequences are found in Table C. In embodiments, any of the cassettes described herein may comprise any poly A sequence from Table C. In embodiments, the poly A sequence comprises a nucleic acid sequence having at least 80%, at least 85%, at least 90%, at least 95%, at least 96%, at least 97%, at least 98%, at least 99%, or 100% identity to a sequence selected from the group consisting of SEQ ID NOS: 112-125, 159-162, 190-192, and 239-240.

Exemplary arrangements of poly A sequences within polycistronic cassettes are found in FIGS. 1A-D, 2A-J, 3A-3C, 4A-4H, 5A-5F, and 6. In embodiments, the nucleic acids described herein comprise one or more poly A sequences from Table C that are located 5' to the polycistronic cassettes. In embodiments, the poly A sequences comprise a terminator. In embodiments, the nucleic acids described herein comprise one or more poly A sequences from Table C that are located 3' to the polycistronic cassettes.

TABLE C

| Name | SEQ ID NO. |
|---|---|
| btGH pA also called "bGH pA" | 112, 120-122, 159, 190 |
| hsGHpA | 113, 161 |
| hsHBB pA also called "HBB pA" | 114-116, 191 |
| btHBB pA | 160 |
| synthetic pA | 117, 125 |
| SPA hsACTB pA also called "SPAActBpA" and "SPA ACTB", "SPA/ACTB", and "SPA/hsActB" | 118 |
| SV40pA also called "SV40 late pA" | 119, 162 |
| SPAACT1 | 123 |
| SPA/PTCH2pA | 124, 240 |
| SPA/CCNB | 239 |
| ocHBB pA | 192 |

In embodiments, the poly A sequence comprises a synthetic pA (SEQ ID NO: 117 or SEQ ID NO: 125) and the transcriptional terminator ACTB (SEQ ID NO: 158). In embodiments, the poly A sequence comprises synthetic pA and a transcriptional terminator. In embodiments, the transcription terminator is ACTB. In embodiments, ACTB has a nucleic acid sequence of SEQ ID NO: 118. In embodiments, the presence of a poly A sequence and a terminator sequence terminates transcription of a polycistronic cassette. In embodiments, transcription of a polycistronic cassette is more effectively terminated when a polycistronic cassette comprises both a poly A sequence and a terminator compared to when the polycistronic cassette only comprises a poly A sequence. In embodiments, the terminator is selected from any terminator sequence described in the following documents which is incorporated by reference herein in its entirety: Nojima et al. Cell Reports 3, 1080-1092 (2013).

In embodiments, a nucleic acid comprises a polyA sequence and a transcriptional terminator (e.g., ACTB) 5' or 3' of the first or last polycistronic cassette within the nucleic acid. The inclusion of a transcriptional terminator 5' or 3' of the first or last polycistronic cassette terminates transcription mediated by an upstream genomic promoter. Thus, only the polycistronic cassettes are transcribed.

In embodiments, the cistrons within a polycistronic cassette are separated by a nucleic acid sequences that encodes a 2A polypeptide (also referred to herein as a "2A peptide"). The term 2A polypeptide refers to a self-cleaving peptide that induces ribosomal skipping during translation of a protein in the cell. In embodiments, the polycistronic cassettes comprise one or more 2A polypeptides selected from the group consisting of E2A, F2A, P2A, and T2A polypeptides. In embodiments, a polycistronic cassette encodes an E2A polypeptide from a nucleic acid sequence selected from SEQ ID NOS. 1 and 9. In embodiments, a polycistronic cassette comprises an F2A polypeptide encoded by a nucleic acid having a sequence selected from SEQ ID NOS. 2 and 10. In embodiments, a polycistronic cassette comprises a P2A polypeptide encoded by a nucleic acid having a sequence selected from SEQ ID NOS. 3-6, 12-14, and 169. In embodiments, a polycistronic cassette comprises a T2A polypeptide encoded by a nucleic acid having a sequence SEQ ID NO: 11. Liu et al. describes additional 2A polypeptides and is incorporated by reference herein in its entirety: Liu et al. Scientific Reports, volume 7, article 2193 (2017). In embodiments, each nucleic acid encoding a 2A polypeptide within the nucleic acids described herein encodes a different amino acid sequence.

In embodiments, when a polycistronic cassette containing cistrons separated by a 2A peptide is expressed, an expressed cistron may comprise an N-terminal proline, a C-terminal fusion of the 2A peptide or a fragment thereof, or a combination thereof. In embodiments, the expressed cistron comprises a C-terminal fusion of the 2A peptide wherein the 2A peptide lacks the C-terminal proline.

In embodiments, when a cistron located at the 5' end of a 2A peptide is expressed, the expressed cistron comprises a C-terminal fusion of the 2A peptide wherein the 2A peptide lacks the C-terminal proline. In embodiments, when a cistron located at the 3' end of a 2A peptide is expressed, the expressed cistron comprises an N-terminal proline. In embodiments, when a cistron is located at the 5' end of a first 2A peptide and at the 3' end of a second 2A peptide, the expressed cistron comprises an N-terminal proline and a C-terminal fusion of the 2A peptide, wherein the C-terminal fusion of the 2A peptide lacks the C-terminal proline of the 2A peptide.

In embodiments, the cistrons within a polycistronic cassette are separated by an internal ribosome entry site (IRES). In embodiments, the nucleic acids described herein comprise one or more IRES having a nucleic acid sequence of any one of SEQ ID NOS: 11, 194, and 195. In embodiments, when a polycistronic cassette containing cistrons separated by an IRES is expressed, the expressed cistron is the wild-type protein.

In embodiments, the nucleic acids provided herein comprise a first insulator sequence that is 5' to the 5' polycistronic cassette and a second insulator sequence that is 3' to the 3' polycistronic cassette. In embodiments, the insulator is HS4. In embodiments, HS4 has a sequence selected from any one of SEQ ID NOS. 49-58, 163, and 164. In embodiments, HS4 prevents transcriptional interference from a promoter at a genomic integration site.

In embodiments, the nucleic acids provided herein comprise a first inverted terminal repeat (ITR) located 5' to the 5' polycistronic cassette and having a sequence of SEQ ID NO: 17 or 18, and a second ITR that is 3' to the 3' polycistronic cassette having a sequence of SEQ ID NO: 15 or 16. The inclusion of ITRs in a nucleic acid provided herein enables integration of the nucleic acid into a genome (e.g., a porcine genome) via PiggyBac Transposon-mediated gene transfer.

In embodiments, the nucleic acids provided herein comprise a first loxP site located 5' to the 5' polycistronic cassette and a second loxP site that is 3' to the 3' polycistronic cassette. LoxP sites are nucleic acid sequences that mediate mitotic recombination by a recombinase. The inclusion of loxP sites in a nucleic acid provided herein enables integration of the nucleic acid into a genome (e.g., a porcine genome) via a recombinase. Maizels et al. describes genome engineering with loxP and recombinases and is incorporated by reference herein in its entirety: Maizels et al. J Immunol. 2013; 191(1). In embodiments, the first or second loxP site has a nucleic acid sequence selected from SEQ ID NOS. 146-150 and 244. In embodiments, a region between the first loxP and second loxP site of the nucleic acids described herein is inserted into the genome through recombination.

In embodiments, the nucleic acids provided herein comprise a 5' and 3' guide RNA (gRNA) target sequence (e.g., FOS_sg1 or AAVS_sg3 of FIGS. 5A-F). A gRNA target sequence is recognized by a guide RNA and nuclease (e.g. Cas9). The region between the 5' guide RNA target sequence and 3' gRNA sequence is cleaved by the guide RNA and nuclease. In embodiments, the portion of a nucleic acid comprising multiple polycistronic cassettes described herein between the 5' and 3' gRNA target sequence is integrated into a cell, tissue, organ, or animal. In embodiments, the nucleic acid sequence located between the 5' gRNA target sequence and 3' gRNA target sequence is cloned into a cell, tissue, organ, or animal using homology-independent targeted integration (HITI). Suzuki et al. describes in vivo genome editing using HITI, and is incorporated by reference herein in its entirety: Suzuki et al. Nature. 2016 Dec. 1; 540(7631): 144-149. In embodiments, the nucleic acid sequence located between the 5' and 3' gRNA target sequence is cloned into a cell, tissue, organ, or animal using CRISPR-mediated homology directed repair (HDR). Hsu et al. describes in vivo genome editing using CRISPR-mediated HDR and is incorporated by reference herein in its entirety: Hsu et al. Cell 157, 1262-1278 (2014). In embodiments the 5' gRNA target sequence is FOS (SEQ ID NO: 47) or AAVS (SEQ ID NO: 48). In embodiments the 3' gRNA target sequence is FOS (SEQ ID NO: 47) or AAVS (SEQ ID NO: 48).

Exemplary arrangements of loxP sites, insulator sequences, guide RNA target sequences, and polycistronic cassettes are presented in Table D.

In embodiments, the nucleic acids described herein further comprise a start codon. In embodiments, the nucleic acids described herein further comprise a termination codon. In embodiments, a termination codon is found at the 3' end of each polycistronic cassette. In embodiments, the nucleic acids described herein comprise a Kozak sequence. In embodiments, the Kozak sequence is a nucleic acid of SEQ ID NO: 59 or 61.

In embodiments, the nucleic acids described herein comprise one or more ubiquitous chromatin opening elements (UCOE). Neville et al. describes UCOEs and is incorporated by reference herein in its entirety: Neville et al. Biotechnology Advances 35 (2017) 557-564. In embodiments, polycistronic cassettes of the nucleic acids described herein are separated by UCOEs. In embodiments, the UCOE is selected from Can 6-3, A2CBX3, CBX3, CBX3*, and SRF1. In embodiments, a UCOE comprises any one of the sequences defined by SEQ ID NOS: 19-22, 157, and 193.

In embodiments, the nucleic acids provided herein comprise a fluorescent protein. In embodiments, the fluorescent protein is located 5' to the 5' polycistronic cassette. In embodiments, the fluorescent protein is located 3' to the 3' polycistronic cassette. In embodiments, the fluorescent protein is located 5' of an ITR, gRNA target sequence, loxP site, or combination thereof. In embodiments, the fluorescent protein is used for negative selection. In embodiments, the fluorescent protein is green fluorescent protein. In embodiments, the fluorescent protein is GFP having a nucleic acid sequence of SEQ ID NO: 111. In embodiments, the fluorescent protein is BFP having a nucleic acid sequence of SEQ ID NO: 242 or SEQ ID NO: 246.

In embodiments, any one of the nucleic acids described herein or a fragment thereof is integrated into a chromosome. In embodiments, the fragment thereof is a contiguous portion of the nucleic acids described herein, for example, the fragment may be about 20%, about 25%, about 30%, about 35%, about 40%, about 45%, about 50%, about 55%,

TABLE D

| Arrangement (5' to 3') | | | | | | | | | | |
|---|---|---|---|---|---|---|---|---|---|---|
| First ITR | First loxP site | First insulator sequence | polycistronic cassettes | Second insulator sequence | Second loxP site | Second ITR | | | | |
| First guide RNA target sequence | Second guide RNA target sequence | First lox P site | First insulator sequence | polycistronic cassettes | Second insulator sequence | Second loxP site | Second guide RNA target sequence | First guide RNA target sequence | | |
| First guide RNA target sequence | Second guide RNA target sequence | First ITR | First insulator sequence | First loxP site | Polycistronic cassettes | Second loxP site | Second insulator sequence | Second guide RNA target sequence | First guide RNA target sequence | Second ITR |
| First loxP site | First insulator sequence | polycistronic cassettes | Second insulator sequence | Second loxP site | | | | | | |
| First insulator sequence | First loxP site | polycistronic cassettes | Second loxP site | Second insulator sequence | | | | | | |
| First guide RNA target sequence | Second guide RNA target sequence | First ITR | First loxP site | First insulator sequence | Polycistronic cassettes | Second insulator sequence | Second loxP site | Second guide RNA target sequence | First guide RNA target sequence | Second ITR |
| First guide RNA target sequence | Second guide RNA target sequence | First insulator sequence | First lox P site | polycistronic cassettes | Second loxP site | Second insulator sequence | Second guide RNA target sequence | First guide RNA target sequence | | | about 60%, about 65%, about 70%, about 75%, about 80%, about 85%, about 90%, about 95%, about 97%, about 99%, or about 100% of the nucleotides of any nucleic acid described herein. In embodiments, the fragment comprises at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% of the nucleotides of any nucleic acid described herein.

In embodiments, fragments comprising the individual components of the nucleic acids described herein are amplified from genomic DNA by polymerase chain reaction or synthesized. Adjacent fragments overlap at their 5' or 3' ends by at least 50 base pairs. The fragments are assembled into full length nucleic acids using yeast homologous recombination. A plasmid harboring the nucleic acid is transformed into and amplified in *Escherichia coli*.

Exemplary Nucleic Acids

Exemplary nucleic acids comprising multiple polycistronic cassettes are displayed in FIGS. 1A-D, FIGS. 2A-J, FIGS. 3A-C, FIGS. 4A-H, FIGS. 5A-F, and FIG. 6. In embodiments, a nucleic acid comprising multiple polycistronic cassettes has a sequence selected from any one of SEQ ID NOS: 23-46, 172-177.

In some embodiments, provided herein are nucleic acids comprising: (a) a coagulation cassette comprising a first cistron encoding THBD wherein the nucleic acid sequence of THBD is selected from the group consisting of SEQ ID NOS: 97-102, 166, and 265-266, a second cistron encoding TFPI wherein the nucleic acid sequence of TFPI is selected from the group consisting of SEQ ID NOS: 94-96, 103, and 187, a mouse EF1α1 promoter selected from SEQ ID NOS: 134-135; and a hsHBB polyA ("hsHBB pA" or "HBB pA") sequence selected from SEQ ID NOS. 114-116 and combinations thereof, (b) a complement regulation cassette comprising: a first cistron encoding CD46 wherein the nucleic acid sequence of CD46 is selected from the group consisting of SEQ ID NOS: 71-76, 185, 200, and 253-258, a second cistron encoding CD59 wherein the nucleic acid sequence of CD59 is selected from the group consisting of SEQ ID NOS: 86, 108, a human EF1α1 promoter selected from SEQ ID NOS: 130-132, a btGH pA sequence selected from any one of SEQ ID NOS. 112, 120-122, 159, and 190 and combinations thereof; and an innate immunity cassette comprising: a first cistron encoding a B2M HLA-E fusion protein wherein the nucleic acid sequence encoding the B2M HLA-E fusion protein is selected from the group consisting of SEQ ID NOS: 62, 66, 105, a second cistron encoding CD47 wherein the nucleic acid sequence of CD47 is selected from the group consisting of SEQ ID NOS: 77-83, 180, and 259, a CAG promoter selected from SEQ ID NOS: 126-128; and a SPAActB poly A sequence selected from SEQ ID NOS. 123-125 and 154-156 and combinations thereof. In embodiments, CD46 is CD46_LL comprising a nucleic acid sequence of SEQ ID NO: 71. In embodiments, a UCOE separates the complement regulation cassette and the innate immunity cassette. In embodiments, the UCOE has a sequence selected from SEQ ID NOS: 19-22, 157, and 193. In embodiments, the UCOE is an A2CBX3 UCOE having a sequence of SEQ ID NO: 20.

In some embodiments, provided herein are nucleic acids comprising: (a) a coagulation cassette comprising a first cistron encoding THBD wherein the nucleic acid sequence of THBD is selected from the group consisting of SEQ ID NOS: 97-102, 166, and 265-266, a second cistron encoding TFPI wherein the nucleic acid sequence of TFPI is selected from the group consisting of SEQ ID NOS: 94-96, 103, and 187, a mouse EF1α1 promoter selected from SEQ ID NOS: 134-135; and a hsHBB polyA ("hsHBB pA" or "HBB pA") sequence selected from SEQ ID NOS. 114-116 and combinations thereof, (b) a complement regulation cassette comprising: a first cistron encoding CD46 wherein the nucleic acid sequence of CD46 is selected from the group consisting of SEQ ID NOS: 71-76, 185, 200, and 253-258, a second cistron encoding CD59 wherein the nucleic acid sequence of CD59 is selected from the group consisting of SEQ ID NOS: 86, 108, a human EF1α1 promoter selected from SEQ ID NOS: 130-132, a btGH pA sequence selected from any one of SEQ ID NOS: 112, 120-122, 159, and 190 and combinations thereof; and an innate immunity and inflammation and apoptosis cassette comprising: a first cistron encoding a B2M HLA-E fusion protein wherein the nucleic acid sequence encoding the B2M HLA-E fusion protein is selected from the group consisting of SEQ ID NOS: 62, 66, 105, a second cistron encoding CD47 wherein the nucleic acid sequence of CD47 is selected from the group consisting of SEQ ID NOS: 77-83, 180, and 259, a third cistron encoding A20 wherein the nucleic acid sequence of A20 is selected from the group consisting of SEQ ID NOS: 64-65, 104, 182, and 188, a fourth cistron encoding HO1 wherein the nucleic acid sequence of HO1 is selected from the group consisting of SEQ ID NOS: 63, 109, 165, 183, and 189; a CAG promoter selected from SEQ ID NOS: 126-128; and a SPAActB poly A sequence selected from SEQ ID NOS. 123-125 and 154-156 and combinations thereof. In embodiments, IRES (SEQ ID NO: 11) separates the second and third cistron of the innate immunity and inflammation and apoptosis cassette. In embodiments, a UCOE separates the complement regulation cassette and the innate immunity and inflammation and apoptosis cassette. In embodiments, the UCOE has a sequence selected from SEQ ID NOS: 19-22, 157, and 193. In embodiments, the UCOE is an A2CBX3 UCOE having a sequence of SEQ ID NO: 20.

In some embodiments, provided herein are nucleic acids comprising: (a) a coagulation cassette comprising a first cistron encoding THBD wherein the nucleic acid sequence of THBD is selected from the group consisting of SEQ ID NOS: 97-102, 166, and 265-266, a second cistron encoding TFPI wherein the nucleic acid sequence of TFPI is selected from the group consisting of SEQ ID NOS: 94-96, 103, and 187, a third cistron encoding CD39 wherein the nucleic acid sequence of CD39 is selected from the group consisting of SEQ ID NOS: 67-70 AND SEQ ID NO: 106, a mouse EF1α1 promoter selected from SEQ ID NOS: 134-135; and a hsHBB polyA ("hsHBB pA" or "HBB pA") sequence selected from SEQ ID NOS. 114-116 and combinations thereof, (b) a complement regulation cassette comprising: a first cistron encoding CD46 wherein the nucleic acid sequence of CD46 is selected from the group consisting of SEQ ID NOS: 71-76, 185, 200, and 253-258, a second cistron encoding CD59 wherein the nucleic acid sequence of CD59 is selected from the group consisting of SEQ ID NOS: 86 and 108, a third cistron encoding CD55 wherein the nucleic acid sequence of CD55 is selected from the group consisting of SEQ ID NOS: 84, 85, 107, and 184; a human EF1α1 promoter selected from SEQ ID NOS: 130-132, a btGH pA sequence selected from any one of SEQ ID NOS: 112, 120-122, 159, and 190 and combinations thereof, and an innate immunity and inflammation and apoptosis cassette comprising: a first cistron encoding a B2M HLA-E fusion protein wherein the nucleic acid sequence encoding the B2M HLA-E fusion protein is selected from the group consisting of SEQ ID NOS: 62, 66, 105, a second cistron encoding CD47 wherein the nucleic acid sequence of CD47 is selected from the group consisting of SEQ ID NOS: 77-83, 180, and 259, a third cistron encoding A20 wherein the nucleic acid sequence of A20 is selected from the group consisting of SEQ ID NOS: 64-65, 104, 182, and 188; a fourth cistron encoding HO1 wherein the nucleic acid sequence of HO1 is selected from the group consisting of SEQ ID NOS: 63, 109, 165, 183, and 189; a fifth cistron encoding PD-L1 wherein the nucleic acid sequence of PD-L1 is selected from the group consisting of SEQ ID NOS: 89-91, a CAG promoter selected from SEQ ID NOS: 126-128; and a SPAActB poly A sequence selected from SEQ ID NOS. 123-125 and 154-156 and combinations thereof. In embodiments, IRES (SEQ ID NO: 11) separates the second and third cistron of the innate immunity and inflammation and apoptosis cassette. In embodiments, a UCOE separates the complement regulation cassette and the innate immunity and inflammation and apoptosis cassette. In embodiments, the UCOE has a sequence selected from SEQ ID NOS: 19-22, 157, and 193. In embodiments, the UCOE is an A2CBX3 UCOE having a sequence of SEQ ID NO: 20.

In some embodiments, provided herein are nucleic acids comprising: (a) a coagulation cassette comprising a first cistron encoding THBD wherein the nucleic acid sequence of THBD is selected from the group consisting of SEQ ID NOS: 97-102, 166, and 265-266, a second cistron encoding TFPI wherein the nucleic acid sequence of TFPI is selected from the group consisting of SEQ ID NOS: 94-96, 103, and 187, a mouse EF1α1 promoter selected from SEQ ID NOS: 134-135; and a hsHBB polyA ("hsHBB pA" or "HBB pA") sequence selected from SEQ ID NOS. 114-116 and combinations thereof, (b) a complement regulation cassette comprising: a first cistron encoding CD46 wherein the nucleic acid sequence of CD46 is selected from the group consisting of SEQ ID NOS: 71-76, 185, 200, and 253-258, a second cistron encoding CD59 wherein the nucleic acid sequence of CD59 is selected from the group consisting of SEQ ID NOS: 86, 108, a human EF1α1 promoter selected from SEQ ID NOS: 130-132, a btGH pA sequence selected from any one of SEQ ID NOS. 112, 120-122, 159, and 190 and combinations thereof; and an innate immunity cassette comprising: a first cistron encoding a B2M HLA-E fusion protein wherein the nucleic acid sequence encoding the B2M HLA-E fusion protein is selected from the group consisting of SEQ ID NOS: 62, 66, 105, a second cistron encoding CD47 wherein the nucleic acid sequence of CD47 is selected from the group consisting of SEQ ID NOS: 77-83, 180, and 259, a CAG promoter selected from SEQ ID NOS: 126-128; and a SPAActB poly A sequence selected from SEQ ID NOS. 123-125 and 154-156 and combinations thereof. In embodiments, CD46 is CD46_LL comprising a nucleic acid sequence of SEQ ID NO: 71. In embodiments, a UCOE separates the complement regulation cassette and the innate immunity cassette. In embodiments, the UCOE has a sequence selected from SEQ ID NOS: 19-22, 157, and 193. In embodiments, the UCOE is an A2CBX3 UCOE having a sequence of SEQ ID NO: 20. In embodiments, a UCOE having a sequence selected from SEQ ID NOS: 19-22, 157, and 193 is located 5' or 3' of the coagulation cassette. In embodiments, a UCOE having a sequence selected from SEQ ID NOS: 19-22, 157, and 193 is located 5' or 3' of the coagulation cassette. In embodiments, the UCOE located 5' or 3' of the coagulation cassette is SRF having a sequence of SEQ ID NO: 22.

In some embodiments, provided herein are nucleic acids comprising: (a) a coagulation cassette comprising a first cistron encoding THBD wherein the nucleic acid sequence of THBD is selected from the group consisting of SEQ ID NOS: 97-102, 166, and 265-266, a second cistron encoding TFPI wherein the nucleic acid sequence of TFPI is selected from the group consisting of SEQ ID NOS: 94-96, 103, and 187, a third cistron encoding CD39 wherein the nucleic acid sequence of CD39 is selected from the group consisting of SEQ ID NOS: 67-70 AND SEQ ID NO: 106, a mouse EF1α1 promoter selected from SEQ ID NOS: 134-135; and a hsHBB polyA ("hsHBB pA" or "HBB pA") sequence selected from SEQ ID NOS. 114-116 and combinations thereof, (b) a complement regulation cassette comprising: a first cistron encoding CD46 wherein the nucleic acid sequence of CD46 is selected from the group consisting of SEQ ID NOS: 71-76, 185, 200, and 253-258, a second cistron encoding CD59 wherein the nucleic acid sequence of CD59 is selected from the group consisting of SEQ ID NOS: 86, 108; a third cistron encoding CD55 wherein the nucleic acid sequence of CD55 is selected from the group consisting of SEQ ID NOS: 84, 85, 107, and 184; a ssEF1α1 promoter selected from SEQ ID NOS: 136-138, a btGH pA sequence selected from any one of SEQ ID NOS. 112, 120-122, 159, and 190 and combinations thereof, and an innate immunity and inflammation and apoptosis cassette comprising: a first cistron encoding a B2M HLA-E fusion protein wherein the nucleic acid sequence encoding the B2M HLA-E fusion protein is selected from the group consisting of SEQ ID NOS: 62, 66, 105, a second cistron encoding CD47 wherein the nucleic acid sequence of CD47 is selected from the group consisting of SEQ ID NOS: 77-83, 180, and 259, a third cistron encoding A20 wherein the nucleic acid sequence of A20 is selected from the group consisting of SEQ ID NOS: 64-65, 104, 182, and 188, a fourth cistron encoding HO1 wherein the nucleic acid sequence of HO1 is selected from the group consisting of SEQ ID NOS: 63, 109, 165, 183, and 189; a fifth cistron encoding PD-L1 wherein the nucleic acid sequence of PD-L1 is selected from the group consisting of SEQ ID NOS: 89-91, a CAG promoter selected from SEQ ID NOS: 126-128; and a SPAActB poly A sequence selected from SEQ ID NOS. 123-125 and 154-156 and combinations thereof. In embodiments, IRES (SEQ ID NO: 11) separates the second and third cistron of the innate immunity and inflammation and apoptosis cassette. In embodiments, a UCOE separates the complement regulation cassette and the innate immunity and inflammation and apoptosis cassette. In embodiments, the UCOE has a sequence selected from SEQ ID NOS: 19-22, 157, and 193. In embodiments, the UCOE is CBX3 UCOE having a sequence of SEQ ID NO: 21. In embodiments, a UCOE is located at the 5' or 3' of the coagulation cassette. In embodiments, a UCOE located at the 5' or 3' of the coagulation cassette is a Can 6-3 UCOE having a sequence of SEQ ID NO: 19. In embodiments, the CD46 is CD46i having a nucleic acid sequence selected from SEQ ID NO: 74 or SEQ ID NO: 75.

In some embodiments, provided herein are nucleic acids comprising: (a) a coagulation cassette comprising a first cistron encoding THBD wherein the nucleic acid sequence of THBD is selected from the group consisting of SEQ ID NOS: 97-102, 166, and 265-266, a second cistron encoding TFPI wherein the nucleic acid sequence of TFPI is selected from the group consisting of SEQ ID NOS: 94-96, 103, and 187, a third cistron encoding CD39 wherein the nucleic acid sequence of CD39 is selected from the group consisting of SEQ ID NOS: 67-70 AND SEQ ID NO: 106, a ssUBC promoter having a sequence of SEQ ID NO: 141; and a hsHBB polyA ("hsHBB pA" or "HBB pA") sequence selected from any one of SEQ ID NOS. 114-116 and 191; and combinations thereof, (b) a complement regulation cassette comprising: a first cistron encoding CD46 wherein the nucleic acid sequence of CD46 is selected from the group consisting of SEQ ID NOS: 71-76, 185, 200, and 253-258, a second cistron encoding CD59 wherein the nucleic acid sequence of CD59 is selected from the group consisting of SEQ ID NOS: 86, 108, a third cistron encoding CD55 wherein the nucleic acid sequence of CD55 is selected from the group consisting of SEQ ID NOS: 84, 85, 107, and 184; a ssEF1α1 promoter selected from SEQ ID NOS: 136-138, a btGH pA sequence selected from SEQ ID NOS. 112, 120-122, 159, 190 and combinations thereof, and an innate immunity and inflammation and apoptosis cassette comprising: a first cistron encoding a B2M HLA-E fusion protein wherein the nucleic acid sequence encoding the B2M HLA-E fusion protein is selected from the group consisting of SEQ ID NOS: 62, 66, 105, a second cistron encoding CD47 wherein the nucleic acid sequence of CD47 is selected from the group consisting of SEQ ID NOS: 77-83, 180, and 259, a third cistron encoding A20 wherein the nucleic acid sequence of A20 is selected from the group consisting of SEQ ID NOS: 64-65, 104, 182, and 188, a fourth cistron encoding HO1 wherein the nucleic acid sequence of HO1 is selected from the group consisting of SEQ ID NOS: 63, 109, 165, 183, and 189; a fifth cistron encoding PD-L1 wherein the nucleic acid sequence of PD-L1 is selected from the group consisting of SEQ ID NOS: 89-91, a CAG promoter selected from SEQ ID NOS: 126-128; and a SPAActB poly A sequence selected from SEQ ID NOS. 123-125 and 154-156 and combinations thereof. In embodiments, IRES (SEQ ID NO: 11) separates the second and third cistron of the innate immunity and inflammation and apoptosis cassette. In embodiments, a UCOE separates the complement regulation cassette and the innate immunity and inflammation and apoptosis cassette. In embodiments, the UCOE has a sequence selected from SEQ ID NOS: 19-22, 157, and 193. In embodiments, the UCOE is CBX3 UCOE having a sequence of SEQ ID NO: 21. In embodiments, the CD46 is CD46i having a nucleic acid sequence selected from SEQ ID NO: 74 or SEQ ID NO: 75.

In some embodiments, provided herein are nucleic acids comprising: (a) a coagulation cassette comprising a first cistron encoding THBD wherein the nucleic acid sequence of THBD is selected from the group consisting of SEQ ID NOS: 97-102, 166, and 265-266, a second cistron encoding PROCR wherein the nucleic acid sequence of PROCR is selected from the group consisting of SEQ ID NOS: 92, 93, and 181, a ssUBC promoter having a sequence of SEQ ID NO: 19-22, 157, or 193; and a hsHBB polyA ("hsHBB pA" or "HBB pA") sequence selected from any one of SEQ ID NOS. 114-116 and 191 and combinations thereof, (b) an inflammation and apoptosis cassette comprising: a first cistron encoding A20 wherein the nucleic acid sequence of A20 is selected from the group consisting of SEQ ID NOS: 64-65, 104, 182, and 188, a second cistron encoding HO1 wherein the nucleic acid sequence of HO1 is selected from the group consisting of SEQ ID NOS: 63, 109, 165, 183, and 189; a ssEF1α1 promoter selected from SEQ ID NOS: 136-138, and 179, a btGH pA sequence selected from SEQ ID NOS. 112, 120-122, 159, 190 and combinations thereof; and a complement regulation and innate immunity cassette comprising: a first cistron encoding CD46 wherein the nucleic acid sequence of CD46 is selected from the group consisting of SEQ ID NOS: 71-76, 185, 200, and 253-258, a second cistron encoding CD47 wherein the nucleic acid sequence of CD47 is selected from the group consisting of SEQ ID NOS: 77-83, 180, and 259, a third cistron encoding CD55 wherein the nucleic acid sequence of CD55 is selected from the group consisting of SEQ ID NOS: 84, 85, 107, and 184; a CAG promoter selected from SEQ ID NOS: 126-128; and a SPAActB poly A sequence selected from SEQ ID NOS. 123-125 and 154-156 and combinations thereof. In embodiments, a UCOE separates the inflammation and apoptosis cassette from the complement regulation and innate immunity cassette. In embodiments, the UCOE has a sequence selected from SEQ ID NOS: 19-22, 157, and 193. In embodiments, the UCOE is a CBX3 UCOE having a sequence of SEQ ID NO: 21. In embodiments, the CD46 is CD46i having a nucleic acid sequence selected from SEQ ID NO: 74 or SEQ ID NO: 75.

In some embodiments, provided herein are nucleic acids comprising: (a) a coagulation cassette comprising a first cistron encoding THBD wherein the nucleic acid sequence of THBD is selected from the group consisting of SEQ ID NOS: 97-102, 166, and 265-266, a second cistron encoding PROCR wherein the nucleic acid sequence of PROCR is selected from the group consisting of SEQ ID NOS: 92, 93, and 181, a third cistron encoding TFPI wherein the nucleic acid sequence of TFPI is selected from the group consisting of SEQ ID NOS: 94-96, 103, and 187; a ssUBC promoter having a sequence of SEQ ID NO: 141; and a hsHBB polyA ("hsHBB pA" or "HBB pA") sequence selected from any one of SEQ ID NOS. 114-116 and 191 and combinations thereof, (b) an innate immunity cassette comprising: a first cistron encoding a B2M HLA-E fusion protein wherein the nucleic acid sequence encoding the B2M HLA-E fusion protein is selected from the group consisting of SEQ ID NOS: 62, 66, 105, a second cistron encoding CD47 wherein the nucleic acid sequence of CD47 is selected from the group consisting of SEQ ID NOS: 77-83, 180, and 259; a ssHSPA8 promoter selected from SEQ ID NOS: 139-140; and a btGH pA sequence selected from SEQ ID NOS. 112, 120-122, 159, 190 and combinations thereof, and (c) a complement regulation cassette comprising: a first cistron encoding CD46 wherein the nucleic acid sequence of CD46 is selected from the group consisting of SEQ ID NOS: 71-76, 185, 200, and 253-258, a second cistron encoding CD55 wherein the nucleic acid sequence of CD55 is selected from the group consisting of SEQ ID NOS: 84, 85, 107, and 184, a CAG promoter selected from SEQ ID NOS: 126-128, and a hsGH poly A sequence having a sequence of SEQ ID NO: 113. In embodiments, a UCOE separates the innate immunity cassette from the complement regulation cassette. In embodiments, the UCOE has a sequence selected from SEQ ID NOS: 19-22, 157, and 193. In embodiments, the UCOE is a CBX3 UCOE having a sequence of SEQ ID NO: 21. In embodiments, a polyA is located 5' or 3' of the coagulation cassette. In embodiments, the polyA is SV40 pA having a sequence of SEQ ID NO: 119. In embodiments, the CD46 is CD46da having a sequence of SEQ ID NO: 73 or SEQ ID NO: 72. In embodiments, the THBD is THBDda having a sequence selected from SEQ ID NOS: 99-102. In embodiments, the B2M HLA-E fusion protein comprises an HLA-G epitope. In embodiments, CD47 is CD47-2 (e.g. NM_198793) having a sequence of SEQ ID NO: 80, 81, or 83. In embodiments, a polyA is located 5' or 3' of the complement regulation cassette. In embodiments, the polyA located 5' or 3' of the complement regulation cassette is a SPAActB pA having a sequence of SEQ ID NO: 118.

In some embodiments, provided herein are nucleic acids comprising: (a) an innate immunity cassette comprising; a first cistron encoding a B2M HLA-E fusion protein wherein the nucleic acid sequence encoding the B2M HLA-E fusion protein is selected from the group consisting of SEQ ID NOS: 62, 66, 105, a second cistron encoding CD47 wherein the nucleic acid sequence of CD47 is selected from the group consisting of SEQ ID NOS: 77-83, 180, and 259; a ssUBC promoter having a sequence of SEQ ID NO: 141; and a hsHBB polyA ("hsHBB pA" or "HBB pA") sequence selected from any one of SEQ ID NOS. 114-116 and 191 and combinations thereof, (b) a coagulation cassette comprising: a first cistron encoding THBD wherein the nucleic acid sequence of THBD is selected from the group consisting of SEQ ID NOS: 97-102, 166, and 265-266, a second cistron encoding PROCR wherein the nucleic acid sequence of PROCR is selected from the group consisting of SEQ ID NOS: 92, 93, and 181, a third cistron encoding TFPI wherein the nucleic acid sequence of TFPI is selected from the group consisting of SEQ ID NOS: 94-96, 103, and 187, a hsHSPA8 promoter having a sequence of SEQ ID NO: 133; and a btGH pA sequence selected from SEQ ID NOS. 112, 120-122, 159, 190 and combinations thereof, and (c) a complement regulation cassette comprising: a first cistron encoding CD46 wherein the nucleic acid sequence of CD46 is selected from the group consisting of SEQ ID NOS: 71-76, 185, 200, and 253-258, a second cistron encoding CD55 wherein the nucleic acid sequence of CD55 is selected from the group consisting of SEQ ID NOS: 84, 85, 107, and 184, a CAG promoter selected from SEQ ID NOS: 126-128, and a hsGH poly A sequence having a sequence of SEQ ID NO: 113 and combinations thereof. In embodiments, a UCOE separates the innate immunity cassette from the complement regulation cassette. In embodiments, the UCOE has a sequence selected from SEQ ID NOS: 19-22, 157, and 193. In embodiments, the UCOE is an A2CBX3 UCOE having a sequence of SEQ ID NO: 20. In embodiments, a polyA is located 5' or 3' of the innate immunity cassette. In embodiments, the polyA is SV40 pA having a sequence of SEQ ID NO: 119. In embodiments, the CD46 is CD46da having a sequence of SEQ ID NO: 73 or SEQ ID NO: 72. In embodiments, the THBD is THBDda having a sequence selected from SEQ ID NOS: 99-102. In embodiments, the B2M HLA-E fusion protein comprises an HLA-G epitope. In embodiments, CD47 is CD47-2 (e.g. NM_198793) having a sequence of SEQ ID NO: 80, 81, or 83. In embodiments, a polyA is located 5' or 3' of the complement regulation cassette. In embodiments, the polyA located 5' or 3' of the complement regulation cassette is a SPAActB pA having a sequence of SEQ ID NO: 118. In embodiments, the nucleic acid comprises a gRNA target sequence selected from SEQ ID NOS: 47-48.

In some embodiments, provided herein are nucleic acids comprising: (a) an innate immunity cassette comprising; a first cistron encoding a B2M HLA-E fusion protein wherein the nucleic acid sequence encoding the B2M HLA-E fusion protein is selected from the group consisting of SEQ ID NOS: 62, 66, 105, a second cistron encoding CD47 wherein the nucleic acid sequence of CD47 is selected from the group consisting of SEQ ID NOS: 77-83, 180, and 259; a ssUBC promoter having a sequence of SEQ ID NO: 141; and a hsHBB polyA ("hsHBB pA" or "HBB pA") sequence selected from any one of SEQ ID NOS. 114-116 and 191 and combinations thereof, (b) a coagulation cassette comprising: a first cistron encoding THBD wherein the nucleic acid sequence of THBD is selected from the group consisting of SEQ ID NOS: 97-102, 166, and 265-266, a second cistron encoding PROCR wherein the nucleic acid sequence of PROCR is selected from the group consisting of SEQ ID NOS: 92, 93, and 181, a third cistron encoding TFPI wherein the nucleic acid sequence of TFPI is selected from the group consisting of SEQ ID NOS: 94-96, 103, and 187, a hsHSPA8 promoter having a sequence of SEQ ID NO: 133; and a btGH pA sequence selected from SEQ ID NOS. 112, 120-122, 159, 190 and combinations thereof, and (c) a complement regulation cassette comprising: a first cistron encoding CD46 wherein the nucleic acid sequence of CD46 is selected from the group consisting of SEQ ID NOS: 71-76, 185, 200, and 253-258, a second cistron encoding CD55 wherein the nucleic acid sequence of CD55 is selected from the group consisting of SEQ ID NOS: 84, 85, 107, and 184, a CAG promoter selected from SEQ ID NOS: 126-128, and a hsGH poly A sequence having a sequence of SEQ ID NO: 113, and combinations thereof. In embodiments, a UCOE separates the innate immunity cassette from the complement regulation cassette. In embodiments, the UCOE has a sequence selected from SEQ ID NOS: 19-22 and 157. In embodiments, the UCOE is an A2CBX3 UCOE having a sequence of SEQ ID NO: 20. In embodiments, a polyA is located 5' or 3' of the innate immunity cassette. In embodiments, the polyA is SV40 pA having a sequence of SEQ ID NO: 119. In embodiments, the CD46 is CD46da having a sequence of SEQ ID NO: 73 or SEQ ID NO: 72. In embodiments, the THBD is THBDda having a sequence selected from SEQ ID NOS: 99-102. In embodiments, the B2M HLA-E fusion protein comprises an HLA-G epitope. In embodiments, CD47 is CD47-2 (e.g. NM_198793) having a sequence of SEQ ID NO: 80, 81, or 83. In embodiments, a polyA is located 5' or 3' of the complement regulation cassette. In embodiments, the polyA located 5' or 3' of the complement regulation cassette is a SPAActB pA having a sequence of SEQ ID NO: 118. In embodiments, the nucleic acid comprises a gRNA target sequence selected from SEQ ID NOS: 47-48.

In some embodiments, provided herein are nucleic acids comprising: (a) a coagulation cassette comprising a first cistron encoding THBD wherein the nucleic acid sequence of THBD is selected from the group consisting of SEQ ID NOS: 97-102, 166, and 265-266, a second cistron encoding PROCR wherein the nucleic acid sequence of PROCR is selected from the group consisting of SEQ ID NOS: 92, 93, and 181, a third cistron encoding TFPI wherein the nucleic acid sequence of TFPI is selected from the group consisting of SEQ ID NOS: 94-96, 103, and 187; a ssUBC promoter having a sequence of SEQ ID NO: 141; and a hsHBB polyA ("hsHBB pA" or "HBB pA") sequence selected from any one of SEQ ID NOS. 114-116 and 191 and combinations thereof, (b) an innate immunity cassette comprising: a first cistron encoding a B2M HLA-E fusion protein wherein the nucleic acid sequence encoding the B2M HLA-E fusion protein is selected from the group consisting of SEQ ID NOS: 62, 66, 105, a second cistron encoding CD47 wherein the nucleic acid sequence of CD47 is selected from the group consisting of SEQ ID NOS: 77-83, 180, and 259; a ssEF1α1 promoter selected from SEQ ID NOS: 136-138, and 179; and a btGH pA sequence selected from SEQ ID NOS. 112, 120-122, 159, 190 and combinations thereof, and (c) a complement regulation cassette comprising: a first cistron encoding CD46 wherein the nucleic acid sequence of CD46 is selected from the group consisting of SEQ ID NOS: 71-76, 185, 200, and 253-258, a second cistron encoding CD55 wherein the nucleic acid sequence of CD55 is selected from the group consisting of SEQ ID NOS: 84, 85, 107, and 184, a CAG promoter selected from SEQ ID NOS: 126-128, and a SPAActB poly A sequence selected from SEQ ID NOS. 123-125 and 154-156 and combinations thereof. In embodiments, a UCOE separates the innate immunity cassette from the complement regulation cassette. In embodiments, the UCOE has a sequence selected from SEQ ID NOS: 19-22, 157, and 193. In embodiments, the UCOE is a CBX3 UCOE having a sequence of SEQ ID NO: 21. In embodiments, a polyA is located 5' or 3' of the coagulation cassette. In embodiments, the polyA is SV40 pA having a sequence of SEQ ID NO: 119. In embodiments, the CD46 is CD46da having a sequence of SEQ ID NO: 73 or SEQ ID NO: 72. In embodiments, the THBD is THBDda having a sequence selected from SEQ ID NOS: 99-102. In embodiments, the B2M HLA-E fusion protein comprises an HLA-G epitope. In embodiments, CD47 is CD47-2 (e.g. NM_198793) having a sequence of SEQ ID NO: 80, 81, or 83. In embodiments, a polyA is located 5' or 3' of the complement regulation cassette. In embodiments, the polyA located 5' or 3' of the complement regulation cassette is a SPAActB pA having a sequence of SEQ ID NO: 118. In embodiments, the nucleic acid comprises a gRNA target sequence selected from SEQ ID NOS: 47-48.

In some embodiments, provided herein are nucleic acids comprising: (a) a coagulation cassette comprising a first cistron encoding THBD wherein the nucleic acid sequence of THBD is selected from the group consisting of SEQ ID NOS: 97-102, 166, and 265-266, a second cistron encoding TFPI wherein the nucleic acid sequence of TFPI is selected from the group consisting of SEQ ID NOS: 94-96, 103, and 187, a mouse EF1α1 promoter selected from SEQ ID NOS: 134-135; and a hsHBB polyA ("hsHBB pA" or "HBB pA") sequence selected from any one of SEQ ID NOS. 114-116 and 191 and combinations thereof, (b) a complement regulation cassette comprising: a first cistron encoding CD46 wherein the nucleic acid sequence of CD46 is selected from the group consisting of SEQ ID NOS: 71-76, 185, 200, and 253-258, a second cistron encoding CD55 wherein the nucleic acid sequence of CD55 is selected from the group consisting of SEQ ID NOS: 84, 85, 107, and 184, a human EF1α1 promoter selected from SEQ ID NOS: 130-132, a btGH pA sequence selected from SEQ ID NOS. 112, 120-122, 159, 190 and combinations thereof; and an innate immunity cassette comprising: a first cistron encoding a B2M HLA-E fusion protein wherein the nucleic acid sequence encoding the B2M HLA-E fusion protein is selected from the group consisting of SEQ ID NOS: 62, 66, 105, a second cistron encoding CD47 wherein the nucleic acid sequence of CD47 is selected from the group consisting of SEQ ID NOS: 77-83, 180, and 259, a CAG promoter selected from SEQ ID NOS: 126-128; and a SPAActB poly A sequence selected from SEQ ID NOS. 123-125 and 154-156 and combinations thereof. In embodiments, a UCOE separates the complement regulation cassette and the innate immunity cassette. In embodiments, the UCOE has a sequence selected from SEQ ID NOS: 19-22, 157, and 193. In embodiments, the UCOE is an A2CBX3 UCOE having a sequence of SEQ ID NO: 20. In embodiments, a UCOE having a sequence selected from SEQ ID NOS: 19-22, 157, and 193 is located 5' or 3' of the coagulation cassette. In embodiments, a UCOE having a sequence selected from SEQ ID NOS: 19-22, 157, and 193 is located 5' or 3' of the coagulation cassette. In embodiments, the UCOE located 5' or 3' of the coagulation cassette is SRF having a sequence of SEQ ID NO: 22. In embodiments, the CD46 is CD46i having a nucleic acid sequence selected from SEQ ID NO: 74 or SEQ ID NO: 75.

In some embodiments, provided herein are nucleic acids comprising: (a) a coagulation cassette comprising a first cistron encoding THBD wherein the nucleic acid sequence of THBD is selected from the group consisting of SEQ ID NOS: 97-102, 166, and 265-266, a second cistron encoding PROCR wherein the nucleic acid sequence of PROCR is selected from the group consisting of SEQ ID NOS: 92, 93, and 181, a mouse EF1α1 promoter selected from SEQ ID NOS: 134-135; and a hsHBB polyA ("hsHBB pA" or "HBB pA") sequence selected from any one of SEQ ID NOS. 114-116 and 191 and combinations thereof, (b) a complement regulation cassette comprising: a first cistron encoding CD46 wherein the nucleic acid sequence of CD46 is selected from the group consisting of SEQ ID NOS: 71-76, 185, 200, and 253-258, a second cistron encoding CD55 wherein the nucleic acid sequence of CD55 is selected from the group consisting of SEQ ID NOS: 84, 85, 107, and 184, a human EF1α1 promoter selected from SEQ ID NOS: 130-132, a btGH pA sequence selected from SEQ ID NOS. 112, 120-122, 159, 190 and combinations thereof, and (c) an innate immunity and inflammation and apoptosis cassette comprising: a first cistron encoding a B2M HLA-E fusion protein wherein the nucleic acid sequence encoding the B2M HLA-E fusion protein is selected from the group consisting of SEQ ID NOS: 62, 66, 105, a second cistron encoding CD47 wherein the nucleic acid sequence of CD47 is selected from the group consisting of SEQ ID NOS: 77-83, 180, and 259, a third cistron encoding A20 wherein the nucleic acid sequence of A20 is selected from the group consisting of SEQ ID NOS: 64-65, 104, 182, and 188, a fourth cistron encoding HO1 wherein the nucleic acid sequence of HO1 is selected from the group consisting of SEQ ID NOS: 63, 109, 165, 183, and 1895; a CAG promoter selected from SEQ ID NOS: 126-128; and a SPAActB poly A sequence selected from SEQ ID NOS. 123-125 and 154-156 and combinations thereof. In embodiments, an IRES having a sequence of SEQ ID NO: 11 separates the B2M HLA-E fusion protein and CD47 from A20 and HO1. some embodiments, a UCOE separates the complement regulation cassette and the innate immunity cassette. In embodiments, the UCOE has a sequence selected from SEQ ID NOS: 19-22 and 157. In embodiments, the UCOE is an A2CBX3 UCOE having a sequence of SEQ ID NO: 20. In embodiments, a UCOE having a sequence selected from SEQ ID NOS: 19-22, 157, and 193 is located 5' or 3' of the coagulation cassette. In embodiments, a UCOE having a sequence selected from SEQ ID NOS: 19-22 and 157 is located 5' or 3' of the coagulation cassette. In embodiments, the UCOE located 5' or 3' of the coagulation cassette is SRF having a sequence of SEQ ID NO: 22. In embodiments, the CD46 is CD46i having a nucleic acid sequence selected from SEQ ID NO: 74 or SEQ ID NO: 75.

In some embodiments, provided herein are nucleic acids comprising: (a) an innate immunity cassette comprising a first cistron encoding a B2M HLA-E fusion protein wherein the nucleic acid sequence encoding the B2M HLA-E fusion protein is selected from the group consisting of SEQ ID NOS: 62, 66, 105, a second cistron encoding CD47 wherein the nucleic acid sequence of CD47 is selected from the group consisting of SEQ ID NOS: 77-83, 180, and 259, a mouse EF1α1 promoter selected from SEQ ID NOS: 134-135; and a hsHBB polyA ("hsHBB pA" or "HBB pA") sequence selected from any one of SEQ ID NOS. 114-116 and 191 and combinations thereof, (b) a coagulation cassette comprising: a first cistron encoding THBD wherein the nucleic acid sequence of THBD is selected from the group consisting of SEQ ID NOS: 97-102, 166, and 265-266, a second cistron encoding TFPI wherein the nucleic acid sequence of TFPI is selected from the group consisting of SEQ ID NOS: 94-96, 103, and 187, a third cistron encoding CD39 wherein the nucleic acid sequence of CD39 is selected from the group consisting of SEQ ID NOS: 67-70 AND SEQ ID NO: 106, a human EF1α1 promoter selected from SEQ ID NOS: 130-132, a btGH pA sequence selected from SEQ ID NOS. 112, 120-122, 159, 190 and combinations thereof; and (c) a complement regulation and inflammation and apoptosis cassette comprising: a first cistron encoding CD46 wherein the nucleic acid sequence of CD46 is selected from the group consisting of SEQ ID NOS: 71-76, 185, 200, and 253-258, a second cistron encoding CD59 wherein the nucleic acid sequence of CD59 is selected from the group consisting of SEQ ID NOS: 86, 108, a third cistron encoding CD55 wherein the nucleic acid sequence of CD55 is selected from the group consisting of SEQ ID NOS: 84, 85, 107, and 184, a fourth cistron encoding A20 wherein the nucleic acid sequence of A20 is selected from the group consisting of SEQ ID NOS: 64-65, 104, 182, and 188, a fifth cistron encoding HO1 wherein the nucleic acid sequence of HO1 is selected from the group consisting of SEQ ID NOS: 63, 109, 165, 183, and 189; a sixth cistron encoding PD-L1 wherein the nucleic acid sequence of PD-L1 is selected from the group consisting of SEQ ID NOS: 89-91, a CAG promoter selected from SEQ ID NOS: 126-128; and a SPAActB poly A sequence selected from SEQ ID NOS. 123-125 and 154-156 and combinations thereof. In embodiments, an IRES having a sequence of SEQ ID NO: 11 separates CD46, CD55, and CD59 from A20, HO1, and PD-L1. some embodiments, a UCOE separates the complement regulation cassette and the innate immunity cassette. In embodiments, the UCOE has a sequence selected from SEQ ID NOS: 19-22 and 157. In embodiments, the UCOE is an A2CBX3 UCOE having a sequence of SEQ ID NO: 20. In embodiments, a UCOE having a sequence selected from SEQ ID NOS: 19-22, 157, and 193 is located 5' or 3' of the coagulation cassette. In embodiments, a UCOE having a sequence selected from SEQ ID NOS: 19-22 and 157 is located 5' or 3' of the coagulation cassette. In embodiments, the UCOE located 5' or 3' of the coagulation cassette is SRF having a sequence of SEQ ID NO: 22. In embodiments, the CD46 is CD46i having a nucleic acid sequence selected from SEQ ID NO: 74 or SEQ ID NO: 75.

In some embodiments, provided herein are nucleic acids comprising: (a) an innate immunity cassette comprising a first cistron encoding a B2M HLA-E fusion protein wherein the nucleic acid sequence encoding the B2M HLA-E fusion protein is selected from the group consisting of SEQ ID NOS: 62, 66, 105, a second cistron encoding CD47 wherein the nucleic acid sequence of CD47 is selected from the group consisting of SEQ ID NOS: 77-83, 180, and 259, a ssUBC promoter having a sequence of SEQ ID NO: 141; and a hsHBB polyA ("hsHBB pA" or "HBB pA") sequence selected from any one of SEQ ID NOS. 114-116 and 191 and combinations thereof, (b) a coagulation cassette comprising: a first cistron encoding THBD wherein the nucleic acid sequence of THBD is selected from the group consisting of SEQ ID NOS: 97-102, 166, and 265-266, a second cistron encoding TFPI wherein the nucleic acid sequence of TFPI is selected from the group consisting of SEQ ID NOS: 94-96, 103, and 187, a hsHSPA8 promoter selected from SEQ ID NO: 133, a btGH pA sequence selected from SEQ ID NOS. 112, 120-122, 159, 190 and combinations thereof; and (c) a complement regulation cassette comprising: a first cistron encoding CD46 wherein the nucleic acid sequence of CD46 is selected from the group consisting of SEQ ID NOS: 71-76, 185, 200, and 253-258, a second cistron encoding CD55 wherein the nucleic acid sequence of CD55 is selected from the group consisting of SEQ ID NOS: 84, 85, 107, and 184, a CAG promoter selected from SEQ ID NOS: 126-128; and a SPAActB poly A sequence selected from SEQ ID NOS. 123-125 and 154-156 and combinations thereof. In embodiments, a UCOE separates the complement regulation cassette and the coagulation cassette. In embodiments, the UCOE has a sequence selected from SEQ ID NOS: 19-22, 157, and 193. In embodiments, the UCOE is an A2CBX3 UCOE having a sequence of SEQ ID NO: 20. In embodiments, a UCOE having a sequence selected from SEQ ID NOS: 19-22, 157, and 193 is located 5' or 3' of the innate immunity cassette. In embodiments, a UCOE having a sequence selected from SEQ ID NOS: 19-22, 157, and 193 is located 5' or 3' of the innate immunity cassette. In embodiments, the UCOE located 5' or 3' of the innate immunity cassette is SRF having a sequence of SEQ ID NO: 22. In embodiments, the CD46 is CD46i having a nucleic acid sequence selected from SEQ ID NO: 74 or SEQ ID NO: 75.

In some embodiments, provided herein are nucleic acids comprising: (a) an innate immunity cassette comprising a first cistron encoding a B2M HLA-E fusion protein wherein the nucleic acid sequence encoding the B2M HLA-E fusion protein is selected from the group consisting of SEQ ID NOS: 62, 66, 105, a second cistron encoding CD47 wherein the nucleic acid sequence of CD47 is selected from the group consisting of SEQ ID NOS: 77-83, 180, and 259, a ssUBC promoter having a sequence of SEQ ID NO: 141; and a hsHBB polyA ("hsHBB pA" or "HBB pA") sequence selected from any one of SEQ ID NOS. 114-116 and 191 and combinations thereof, (b) a coagulation cassette comprising: a first cistron encoding THBD wherein the nucleic acid sequence of THBD is selected from the group consisting of SEQ ID NOS: 97-102, 166, and 265-266, a second cistron encoding TFPI wherein the nucleic acid sequence of TFPI is selected from the group consisting of SEQ ID NOS: 94-96, 103, and 187, a hsHSPA8 promoter selected from SEQ ID NO: 133, a btGH pA sequence selected from SEQ ID NOS. 112, 120-122, 159, 190 and combinations thereof; and (c) a complement regulation and inflammation and apoptosis cassette comprising: a first cistron encoding CD46 wherein the nucleic acid sequence of CD46 is selected from the group consisting of SEQ ID NOS: 71-76, 185, 200, and 253-258, a second cistron encoding CD55 wherein the nucleic acid sequence of CD55 is selected from the group consisting of SEQ ID NOS: 84, 85, 107, and 184, a third cistron encoding A20 wherein the nucleic acid sequence of A20 is selected from the group consisting of SEQ ID NOS: 64-65, 104, 182, and 188, a fourth cistron encoding HO1 wherein the nucleic acid sequence of HO1 is selected from the group consisting of SEQ ID NOS: 63, 109, 165, 183, and 189; a CAG promoter selected from SEQ ID NOS: 126-128; and a hsGH poly A sequence having a sequence of SEQ ID NO: 113. In embodiments, an IRES having a sequence of SEQ ID NO: 11 separates CD46 and CD55 from A20 and HO1. In embodiments, a UCOE separates the complement regulation cassette and the coagulation cassette. In embodiments, the UCOE has a sequence selected from SEQ ID NOS: 19-22, 157, and 193. In embodiments, the UCOE is an A2CBX3 UCOE having a sequence of SEQ ID NO: 20. In embodiments, a UCOE having a sequence selected from SEQ ID NOS: 19-22, 157, and 193 is located 5' or 3' of the coagulation cassette. In embodiments, a UCOE having a sequence selected from SEQ ID NOS: 19-22, 157, and 193 is located 5' or 3' of the coagulation cassette. In embodiments, the UCOE located 5' or 3' of the coagulation cassette is SRF having a sequence of SEQ ID NO: 22. In embodiments, the CD46 is CD46da having a nucleic acid sequence selected from SEQ ID NO: 72 or SEQ ID NO: 73.

In embodiments, provided herein are nucleic acids comprising: (a) an innate immunity cassette comprising a first cistron encoding a B2M HLA-E fusion protein wherein the nucleic acid sequence encoding the B2M HLA-E fusion protein is selected from the group consisting of SEQ ID NOS: 62, 66, 105, a second cistron encoding CD47 wherein the nucleic acid sequence of CD47 is selected from the group consisting of SEQ ID NOS: 77-83, 180, and 259, a ssUBC promoter having a sequence of SEQ ID NO: 141; and a hsHBB polyA ("hsHBB pA" or "HBB pA") sequence selected from any one of SEQ ID NOS. 114-116 and 191 and combinations thereof, (b) a coagulation cassette comprising: a first cistron encoding THBD wherein the nucleic acid sequence of THBD is selected from the group consisting of SEQ ID NOS: 97-102, 166, and 265-266, a second cistron encoding TFPI wherein the nucleic acid sequence of TFPI is selected from the group consisting of SEQ ID NOS: 94-96, 103, and 187, a third cistron encoding CD39, wherein the nucleic acid sequence of CD39 is selected from the group consisting of SEQ ID NOS: 67-70 AND SEQ ID NO: 106, a hsHSPA8 promoter selected from SEQ ID NO: 133, a btGH pA sequence selected from SEQ ID NOS. 112, 120-122, 159, 190 and combinations thereof; and (c) a complement regulation and inflammation and apoptosis cassette comprising: a first cistron encoding CD46 wherein the nucleic acid sequence of CD46 is selected from the group consisting of SEQ ID NOS: 71-76, 185, 200, and 253-258, a second cistron encoding CD55 wherein the nucleic acid sequence of CD55 is selected from the group consisting of SEQ ID NOS: 84, 85, 107, and 184, a third cistron encoding CD59 wherein the nucleic acid sequence of CD59 is selected from SEQ ID NO: 86 and SEQ ID NO: 108, a fourth cistron encoding A20 wherein the nucleic acid sequence of A20 is selected from the group consisting of SEQ ID NOS: 64-65, 104, 182, and 188, a fifth cistron encoding HO1 wherein the nucleic acid sequence of HO1 is selected from the group consisting of SEQ ID NOS: 63, 109, 165, 183, and 189, a sixth cistron encoding PD-L1, wherein the nucleic acid sequence of PD-L1 is selected from SEQ ID NOS: 89-91, a CAG promoter selected from SEQ ID NOS: 126-128; and a hsGH poly A sequence having a sequence of SEQ ID NO: 113. In embodiments, an IRES having a sequence of SEQ ID NO: 11 separates CD46, CD55, and CD59 from A20, HO1, and PD-L1. In embodiments, a UCOE separates the complement regulation cassette and the coagulation cassette. In embodiments, the UCOE has a sequence selected from SEQ ID NOS: 19-22, 157, and 193. In embodiments, the UCOE is an A2CBX3 UCOE having a sequence of SEQ ID NO: 20. In embodiments, a UCOE having a sequence selected from SEQ ID NOS: 19-22 and 157 is located 5' or 3' of the coagulation cassette. In embodiments, a UCOE having a sequence selected from SEQ ID NOS: 19-22 and 157 is located 5' or 3' of the coagulation cassette. In embodiments, the UCOE located 5' or 3' of the coagulation cassette is SRF having a sequence of SEQ ID NO: 22. In embodiments, the CD46 is CD46da having a nucleic acid sequence selected from SEQ ID NO: 72 or SEQ ID NO: 73.

In embodiments, provided herein are nucleic acids comprising: (a) an innate immunity cassette comprising: a first cistron encoding a B2M HLA-E fusion protein wherein the nucleic acid sequence encoding the B2M HLA-E fusion protein is selected from the group consisting of SEQ ID NOS: 62, 66, 105, a second cistron encoding CD47 wherein the nucleic acid sequence of CD47 is selected from the group consisting of SEQ ID NOS: 77-83, 180, and 259, a ssUBC promoter having a sequence of SEQ ID NO: 141; and a hsHBB polyA ("hsHBB pA" or "HBB pA") sequence selected from any one of SEQ ID NOS. 114-116 and 191 and combinations thereof, (b) a coagulation cassette comprising: a first cistron encoding THBD wherein the nucleic acid sequence of THBD is selected from the group consisting of SEQ ID NOS: 97-102, 166, and 265-266, a second cistron encoding TFPI wherein the nucleic acid sequence of TFPI is selected from the group consisting of SEQ ID NOS: 94-96, 103, and 187, a third cistron encoding CD39, wherein the nucleic acid sequence of CD39 is selected from the group consisting of SEQ ID NOS: 67-70 AND SEQ ID NO: 106, a ssHSPA8 promoter selected from SEQ ID NOS: 142-145, a btGH pA sequence selected from SEQ ID NOS. 112, 120-122, 159, 190 and combinations thereof, and (c) a complement regulation and inflammation and apoptosis cassette comprising: a first cistron encoding CD46 wherein the nucleic acid sequence of CD46 is selected from the group consisting of SEQ ID NOS: 71-76, 185, 200, and 253-258, a second cistron encoding CD55 wherein the nucleic acid sequence of CD55 is selected from the group consisting of SEQ ID NOS: 84, 85, 107, and 184, a third cistron encoding CD59 wherein the nucleic acid sequence of CD59 is selected from SEQ ID NO: 86 and SEQ ID NO: 108, a fourth cistron encoding A20 wherein the nucleic acid sequence of A20 is selected from the group consisting of SEQ ID NOS: 64-65, 104, 182, and 188, a fifth cistron encoding HO1 wherein the nucleic acid sequence of HO1 is selected from the group consisting of SEQ ID NOS: 63, 109, 165, 183, and 189; a sixth cistron encoding PD-L1, wherein the nucleic acid sequence of PD-L1 is selected from SEQ ID NOS: 89-91, a CAG promoter selected from SEQ ID NOS: 126-128; and a hsGH poly A sequence having a sequence of SEQ ID NO: 113. In embodiments, an IRES having a sequence of SEQ ID NO: 11 separates CD46, CD55, and CD59 from A20, HO1, and PD-L1. In embodiments, a UCOE separates the complement regulation cassette and the coagulation cassette. In embodiments, the UCOE has a sequence selected from SEQ ID NOS: 19-22, 157, and 193. In embodiments, the UCOE is an CBX3*UCOE having a sequence of SEQ ID NO: 21. In embodiments, the nucleic acid comprises a polyA sequence that is located 5' or 3' to all of the polycistronic cassettes. In embodiments, the polyA sequence that is located either 5' or 3' to all of the polycistronic cassettes is a SV40 pA having a nucleic acid sequence of SEQ ID NO: 119 or SEQ ID NO: 162.

In embodiments, provided herein are nucleic acids comprising (a) a coagulation cassette comprising: a first cistron encoding THBD wherein the nucleic acid sequence of THBD is selected from the group consisting of SEQ ID NOS: 97-102, 166, and 265-266, a second cistron encoding TFPI wherein the nucleic acid sequence of TFPI is selected from the group consisting of SEQ ID NOS: 94-96, 103, and 187, a ssHSPA8 promoter selected from SEQ ID NOS: 142-145, a SPA PTCH2 pA sequence having a sequence of SEQ ID NO: 124; (b) an innate immunity cassette comprising a first cistron encoding a B2M HLA-E fusion protein wherein the nucleic acid sequence encoding the B2M HLA-E fusion protein is selected from the group consisting of SEQ ID NOS: 62, 66, 105, a second cistron encoding CD47 wherein the nucleic acid sequence of CD47 is selected from the group consisting of SEQ ID NOS: 77-83, 180, and 259, a ssUBC promoter having a sequence of SEQ ID NO: 141; and a hsHBB polyA ("hsHBB pA" or "HBB pA") sequence selected from any one of SEQ ID NOS. 114-116 and 191 and combinations thereof; (c) a cell immunity and coagulation cassette comprising a first cistron encoding CTLA-4 (e.g., LEA29Y) wherein the nucleic acid sequence of CTLA-4 is selected from the group consisting of SEQ ID NOS: 87-88 and 186, a second cistron encoding CD39 wherein the nucleic acid sequence of CD39 is selected from the group consisting of SEQ ID NOS: 67-70 AND SEQ ID NO: 106, a ssEF1α1 promoter selected from SEQ ID NOS: 136-138, and 179; and a btGH poly A sequence having a sequence of SEQ ID NOS: 112, 120-122, 159, and 190; and (d) a complement regulation cassette comprising a first cistron encoding CD46 wherein the nucleic acid sequence of CD46 is selected from the group consisting of SEQ ID NOS: 71-76, 185, 200, and 253-258, a second cistron encoding CD55 wherein the nucleic acid sequence of CD55 is selected from the group consisting of SEQ ID NOS: 84, 85, 107, and 184, a CAG promoter selected from SEQ ID NOS: 126-128; and a hsGH poly A sequence having a sequence of SEQ ID NO: 113. In embodiments, the nucleic acid comprises a polyA sequence that is located 5' or 3' to all of the polycistronic cassettes. In embodiments, the polyA sequence that is located either 5' or 3' to all of the polycistronic cassettes is a SV40 pA having a nucleic acid sequence of SEQ ID NO: 119. In embodiments, the nucleic acid comprises a fluorescent protein located 5' or 3' to all of the polycistronic cassettes. In embodiments, the fluorescent protein located 5' or 3' to all of the polycistronic cassettes is a green fluorescent protein having a sequence of SEQ ID NO: 111. In embodiments, the CD46 is CD46da having a nucleic acid sequence of SEQ ID NO: 72. In embodiments, the THBD is THBDda having a sequence selected from SEQ ID NOS. 99-102. In embodiments, the TFPI comprises TFPI and the CD4 transmembrane domain. In embodiments, the TFPI has a sequence of SEQ ID NO: 94. In embodiments, a UCOE separates the complement regulation cassette and the cell immunity and coagulation cassette. In embodiments, the UCOE has a sequence selected from SEQ ID NOS: 19-22, 157, and 193. In embodiments, the UCOE is an CBX3*UCOE having a sequence of SEQ ID NO: 21.

In embodiments, provided herein are nucleic acids comprising (a) a coagulation cassette comprising: a first cistron encoding THBD wherein the nucleic acid sequence of THBD is selected from the group consisting of SEQ ID NOS: 97-102, 166, and 265-266, a second cistron encoding TFPI wherein the nucleic acid sequence of TFPI is selected from the group consisting of SEQ ID NOS: 94-96, 103, and 187, a ssHSPA8 promoter selected from SEQ ID NOS: 142-145, a SPA PTCH2 pA sequence having a sequence of SEQ ID NO: 124; (b) an innate immunity cassette comprising a first cistron encoding a B2M HLA-E fusion protein wherein the nucleic acid sequence encoding the B2M HLA-E fusion protein is selected from the group consisting of SEQ ID NOS: 62, 66, 105, a second cistron encoding CD47 wherein the nucleic acid sequence of CD47 is selected from the group consisting of SEQ ID NOS: 77-83, 180, and 259, a ssUBC promoter having a sequence of SEQ ID NO: 141; and a hsHBB polyA ("hsHBB pA" or "HBB pA") sequence selected from any one of SEQ ID NOS. 114-116 and 191 and combinations thereof; (c) an inflammation and apoptosis cassette comprising a first cistron encoding A20 wherein the nucleic acid sequence of A20 is selected from the group consisting of SEQ ID NOS: 64-65, 104, 182, and 188, a second cistron encoding PD-L1 wherein the nucleic acid sequence of PD-L1 is selected from the group consisting of SEQ ID NOS: 89-91, a ssEF1α1 promoter selected from SEQ ID NOS: 136-138, and 179; and a btGH poly A sequence having a sequence of SEQ ID NOS: 112, 120-122, 159, 190; and (d) a complement regulation cassette comprising a first cistron encoding CD46 wherein the nucleic acid sequence of CD46 is selected from the group consisting of SEQ ID NOS: 71-76, 185, 200, and 253-258, a second cistron encoding CD55 wherein the nucleic acid sequence of CD55 is selected from the group consisting of SEQ ID NOS: 84, 85, 107, and 184, a CAG promoter selected from SEQ ID NOS: 126-128; and a hsGH poly A sequence having a sequence of SEQ ID NO: 113. In embodiments, the nucleic acid comprises a polyA sequence that is located 5' or 3' to all of the polycistronic cassettes. In embodiments, the polyA sequence that is located either 5' or 3' to all of the polycistronic cassettes is a SV40 pA having a nucleic acid sequence of SEQ ID NO: 119. In embodiments, the nucleic acid comprises a fluorescent protein located 5' or 3' to all of the polycistronic cassettes. In embodiments, the fluorescent protein located 5' or 3' to all of the polycistronic cassettes is a green fluorescent protein having a sequence of SEQ ID NO: 111. In embodiments, the CD46 is CD46da having a nucleic acid sequence of SEQ ID NO: 72. In embodiments, the THBD is THBDda having a sequence selected from SEQ ID NOS. 99-102. In embodiments, the TFPI comprises TFPI and the CD4 transmembrane domain. In embodiments, the TFPI has a sequence of SEQ ID NO: 94. In embodiments, a UCOE separates the complement regulation cassette and the inflammation and apoptosis cassette. In embodiments, the UCOE has a sequence selected from SEQ ID NOS: 19-22, 157, and 193. In embodiments, the UCOE is an CBX3*UCOE having a sequence of SEQ ID NO: 21.

In embodiments, provided herein are nucleic acids comprising (a) a coagulation cassette comprising: a first cistron encoding THBD wherein the nucleic acid sequence of THBD is selected from the group consisting of SEQ ID NOS: 97-102, 166, and 265-266, a second cistron encoding TFPI wherein the nucleic acid sequence of TFPI is selected from the group consisting of SEQ ID NOS: 94-96, 103, and 187, a ssHSPA8 promoter selected from SEQ ID NOS:

142-145, a SPA PTCH2 pA sequence having a sequence of SEQ ID NO: 124; (b) an innate immunity cassette comprising a first cistron encoding a B2M HLA-E fusion protein wherein the nucleic acid sequence encoding the B2M HLA-E fusion protein is selected from the group consisting of SEQ ID NOS: 62, 66, 105, a second cistron encoding CD47 wherein the nucleic acid sequence of CD47 is selected from the group consisting of SEQ ID NOS: 77-83, 180, and 259, a ssUBC promoter having a sequence of SEQ ID NO: 141; and a hsHBB polyA ("hsHBB pA" or "HBB pA") sequence selected from any one of SEQ ID NOS. 114-116 and 191 and combinations thereof, (c) an apoptosis and coagulation cassette comprising a first cistron encoding XIAP wherein the nucleic acid sequence of XIAP is selected from the group consisting of SEQ ID NOS: 110; (ii) a second cistron encoding CD39 wherein the nucleic acid sequence of CD39 is selected from the group consisting of SEQ ID NOS: 106, a ssEF1α1 promoter selected from SEQ ID NOS: 136-138, and 179; and a btGH poly A sequence having a sequence of any one of SEQ ID NOS: 112, 120-122, 159, 190, and (d) a complement regulation cassette comprising a first cistron encoding CD46 wherein the nucleic acid sequence of CD46 is selected from the group consisting of SEQ ID NOS: 71-76, 185, 200, and 253-258, a second cistron encoding CD55 wherein the nucleic acid sequence of CD55 is selected from the group consisting of SEQ ID NOS: 84, 85, 107, and 184, a CAG promoter selected from SEQ ID NOS: 126-128; and a hsGH poly A sequence having a sequence of SEQ ID NO: 113; and a In embodiments, the nucleic acid comprises a polyA sequence that is located 5' or 3' to all of the polycistronic cassettes. In embodiments, the polyA sequence that is located either 5' or 3' to all of the polycistronic cassettes is a SV40 pA having a nucleic acid sequence of SEQ ID NO: 119. In embodiments, the nucleic acid comprises a fluorescent protein located 5' or 3' to all of the polycistronic cassettes. In embodiments, the fluorescent protein located 5' or 3' to all of the polycistronic cassettes is a green fluorescent protein having a sequence of SEQ ID NO: 111. In embodiments, the CD46 is CD46da having a nucleic acid sequence of SEQ ID NO: 72. In embodiments, the THBD is THBDda having a sequence selected from SEQ ID NOS. 99-102. In embodiments, the TFPI comprises TFPI and the CD4 transmembrane domain. In embodiments, the TFPI has a sequence of SEQ ID NO: 94. In embodiments, a UCOE separates the complement regulation cassette and the apoptosis and coagulation cassette. In embodiments, the UCOE has a sequence selected from SEQ ID NOS: 19-22, 157, and 193. In embodiments, the UCOE is an CBX3*UCOE having a sequence of SEQ ID NO: 21.

In embodiments, provided herein are nucleic acids comprising (a) a coagulation cassette comprising: a first cistron encoding THBD wherein the nucleic acid sequence of THBD is selected from the group consisting of SEQ ID NOS: 97-102, 166, and 265-266, a second cistron encoding TFPI wherein the nucleic acid sequence of TFPI is selected from the group consisting of SEQ ID NOS: 94-96, 103, and 187, a ssHSPA8 promoter selected from SEQ ID NOS: 142-145, a SPA PTCH2 pA sequence having a sequence of SEQ ID NO: 124; (b) an innate immunity cassette comprising a first cistron encoding a B2M HLA-E fusion protein wherein the nucleic acid sequence encoding the B2M HLA-E fusion protein is selected from the group consisting of SEQ ID NOS: 62, 66, 105, a second cistron encoding CD47 wherein the nucleic acid sequence of CD47 is selected from the group consisting of SEQ ID NOS: 77-83, 180, and 259, a ssUBC promoter having a sequence of SEQ ID NO: 141; and a hsHBB polyA ("hsHBB pA" or "HBB pA")

sequence selected from any one of SEQ ID NOS. 114-116 and 191 and combinations thereof, (c) an apoptosis and cell immunity cassette comprising a first cistron encoding A20 wherein the nucleic acid sequence of A20 is selected from the group consisting of SEQ ID NOS: 64-65, 104, 182, and 188, a second cistron encoding CTLA-4 (e.g., LEA29Y) wherein the nucleic acid sequence of CTLA-4 is selected from the group consisting of SEQ ID NOS: 87-88 and 186, a ssEF1α1 promoter selected from SEQ ID NOS: 136-138, and 179; and a btGH poly A sequence having a sequence of any one of SEQ ID NOS: 112, 120-122, 159, and 190 (d) a complement regulation cassette comprising a first cistron encoding CD46 wherein the nucleic acid sequence of CD46 is selected from the group consisting of SEQ ID NOS: 71-76, 185, 200, and 253-258, a second cistron encoding CD55 wherein the nucleic acid sequence of CD55 is selected from the group consisting of SEQ ID NOS: 84, 85, 107, and 184, a CAG promoter selected from SEQ ID NOS: 126-128; and a hsGH poly A sequence having a sequence of SEQ ID NO: 113. In embodiments, the nucleic acid comprises a polyA sequence that is located 5' or 3' to all of the polycistronic cassettes. In embodiments, the polyA sequence that is located either 5' or 3' to all of the polycistronic cassettes is a SV40 pA having a nucleic acid sequence of SEQ ID NO: 119. In embodiments, the nucleic acid comprises a fluorescent protein located 5' or 3' to all of the polycistronic cassettes. In embodiments, the fluorescent protein located 5' or 3' to all of the polycistronic cassettes is a green fluorescent protein having a sequence of SEQ ID NO: 111. In embodiments, the CD46 is CD46da having a nucleic acid sequence of SEQ ID NO: 72. In embodiments, the THBD is THBDda having a sequence selected from SEQ ID NOS. 99-102. In embodiments, the TFPI comprises TFPI and the CD4 transmembrane domain. In embodiments, the TFPI has a sequence of SEQ ID NO: 94. In embodiments, a UCOE separates the complement regulation cassette and the apoptosis and cell immunity cassette. In embodiments, the UCOE has a sequence selected from SEQ ID NOS: 19-22, 157, and 193. In embodiments, the UCOE is a CBX3*UCOE having a sequence of SEQ ID NO: 21.

In embodiments, provided herein are nucleic acids comprising: (a) an innate immunity cassette comprising: a first cistron encoding a B2M HLA-E fusion protein wherein the nucleic acid sequence encoding the B2M HLA-E fusion protein is selected from the group consisting of SEQ ID NOS: 62, 66, 105, a second cistron encoding CD47 wherein the nucleic acid sequence of CD47 is selected from the group consisting of SEQ ID NOS: 77-83, 180, and 259, a ssUBC promoter having a sequence of SEQ ID NO: 141; and a hsHBB polyA ("hsHBB pA" or "HBB pA") sequence selected from any one of SEQ ID NOS. 114-116 and 191 and combinations thereof, (b) an inflammation and apoptosis cassette comprising: a first cistron encoding A20 wherein the nucleic acid sequence of A20 is selected from the group consisting of SEQ ID NOS: 64-65, 104, 182, and 188, a second cistron encoding HO1 wherein the nucleic acid sequence of HO1 is selected from the group consisting of SEQ ID NOS: 63, 109, 165, 183, and 189, and a third cistron encoding PD-L1 wherein the nucleic acid sequence of PD-L1 is selected from the group consisting of SEQ ID NOS: 89-91, a ssHSPA8 promoter selected from SEQ ID NOS: 139-140, 142-145; and a btGH poly A sequence having a sequence of any one of SEQ ID NOS: 112, 120-122, 159, 190; (c) a complement regulation cassette comprising a first cistron encoding CD46 wherein the nucleic acid sequence of CD46 is selected from the group consisting of SEQ ID NOS: 71-76, 185, 200, and 253-258, a second cistron encoding CD55 wherein the nucleic acid sequence of CD55 is selected from the group consisting of SEQ ID NOS: 84, 85, 107, and 184, a third cistron encoding CD59 wherein the nucleic acid sequence of CD59 is selected from SEQ ID NO: 86 and SEQ ID NO: 108, a CAG promoter selected from SEQ ID NOS: 126-128; and a btHBB poly A sequence having a sequence of SEQ ID NO: 160; and a (d) a coagulation cassette comprising: a first cistron encoding THBD wherein the nucleic acid sequence of THBD is selected from the group consisting of SEQ ID NOS: 97-102, 166, and 265-266, a second cistron encoding TFPI wherein the nucleic acid sequence of TFPI is selected from the group consisting of SEQ ID NOS: 94-96, 103, and 187, a ssICAM2 promoter having a sequence of SEQ ID NO: 167, and a hsGH poly A sequence having a sequence of SEQ ID NO: 113 or SEQ ID N: 161. In embodiments, the TFPI has a sequence of SEQ ID NO: 96. In embodiments, a UCOE separates the complement regulation cassette and the inflammation and apoptosis cassette. In embodiments, the UCOE has a sequence selected from SEQ ID NOS: 19-22, 157, and 193. In embodiments, the UCOE is a CBX3*UCOE having a sequence of SEQ ID NO: 21. In embodiments, the nucleic acid comprises a polyA sequence that is located 5' or 3' to all of the polycistronic cassettes. In embodiments, the polyA sequence that is located either 5' or 3' to all of the polycistronic cassettes is a SV40 pA having a nucleic acid sequence of SEQ ID NO: 119 or SEQ ID NO: 162.

In embodiments, provided herein are nucleic acids comprising: (a) a coagulation and innate immunity cassette comprising: (i) a first cistron encoding a THBD protein wherein the nucleic acid sequence of THBD is selected from the group consisting of SEQ ID NOS: 97-102, 166, and 265-266; (ii) a second cistron encoding a CD47 protein wherein the nucleic acid sequence of CD47 is selected from the group consisting of SEQ ID NOS: 77-83 and 180; (ii) a third cistron encoding an EPCR protein wherein the nucleic acid sequence of EPCR is selected from the group consisting of SEQ ID NOS: 94-96, 103, and 187; (iii) a ssUBC promoter selected from SEQ ID NOS: 141, 168, and 178; and (iv) a hsGH poly A sequence selected from SEQ ID NOS. 113 and 161; (b) an apoptosis and cell immunity cassette comprising (i) a first cistron encoding an A20 protein wherein the nucleic acid sequence of A20 is selected from the group consisting of SEQ ID NOS: 64-65, 104, 182, and 188; (ii) a second cistron encoding a HO1 protein wherein the nucleic acid sequence of HO1 is selected from the group consisting of SEQ ID NOS: 63, 109, 165, 183, and 189; (iii) an ssHSPA8 promoter selected from SEQ ID NOS: 139-140 and 142-145; and (iv) a btGH poly A sequence selected from SEQ ID NOS. 112, 120-122, 159, 190; and (c) a complement regulation cassette comprising: (i) a first cistron encoding a CD46 protein wherein the nucleic acid sequence of CD46 is selected from the group consisting of SEQ ID NOS: 71-76, 185, 200, and 253-258; (ii) a second cistron encoding a CD55 protein wherein the nucleic acid sequence of CD55 is selected from the group consisting of SEQ ID NOS: 84, 85, 107, and 184; (iii) a CAG promoter selected from SEQ ID NOS: 126-128; and a (iv) a hsHBB poly A sequence selected from SEQ ID NOS. 114-116, 191. In embodiments, a UCOE separates the apoptosis and cell immunity cassette from the complement regulation cassette. In embodiments, the UCOE has a sequence selected from SEQ ID NOS: 19-22, 157, and 193. In embodiments, the nucleic acid comprises a polyA sequence that is 5' to all of the polycistronic cassettes. In embodiments, the polyA sequence that is 5' to all of the polycistronic cassettes is a btHBB pA having a nucleic acid sequence of SEQ ID NO: 160. In embodiments, the nucleic acid comprises a polyA sequence that is 3' to all of the polycistronic cassettes. In embodiments, the polyA sequence that is 3' to all of the polycistronic cassettes is a SV40 pA having a nucleic acid sequence of SEQ ID NO: 162 or 119.

In embodiments, provided herein are nucleic acids comprising: (a) a coagulation and innate immunity cassette comprising: (i) a first cistron encoding a THBD protein wherein the nucleic acid sequence of THBD is selected from the group consisting of SEQ ID NOS: 97-102, 166, and 265-266; (ii) a second cistron encoding a CD47 protein wherein the nucleic acid sequence of CD47 is selected from the group consisting of SEQ ID NOS: 77-83 and 180; (ii) a third cistron encoding an EPCR protein wherein the nucleic acid sequence of EPCR is selected from the group consisting of SEQ ID NOS: 94-96, 103, and 187; (iii) a ssUBC promoter selected from SEQ ID NOS: 141, 168, and 178; and (iv) a hsGH poly A sequence selected from SEQ ID NOS. 113 and 161; (b) an apoptosis and cell immunity cassette comprising (i) a first cistron encoding an A20 protein wherein the nucleic acid sequence of A20 is selected from the group consisting of SEQ ID NOS: 64-65, 104, 182, and 188; (ii) a second cistron comprising LEA29Y wherein the nucleic acid sequence of LEA29Y is SEQ ID NO: 186; (iii) an ssHSPA8 promoter selected from SEQ ID NOS: 139-140 and 142-145; and (iv) a btGH poly A sequence selected from SEQ ID NOS. 112, 120-122, 159, 190; and (c) a complement regulation cassette comprising: (i) a first cistron encoding a CD46 protein wherein the nucleic acid sequence of CD46 is selected from the group consisting of SEQ ID NOS: 71-76, 185, 200, and 253-258; (ii) a second cistron encoding a CD55 protein wherein the nucleic acid sequence of CD55 is selected from the group consisting of SEQ ID NOS: 84, 85, 107, and 184; (iii) a CAG promoter selected from SEQ ID NOS: 126-128; and a (iv) a hsHBB poly A sequence selected from SEQ ID NOS. 114-116, 191. In embodiments, a UCOE separates the apoptosis and cell immunity cassette from the complement regulation cassette. In embodiments, the UCOE has a sequence selected from SEQ ID NOS: 19-22, 157, and 193. In embodiments, the nucleic acid comprises a polyA sequence that is 5' to all of the polycistronic cassettes. In embodiments, the polyA sequence that is 5' to all of the polycistronic cassettes is a btHBB pA having a nucleic acid sequence of SEQ ID NO: 160. In embodiments, the nucleic acid comprises a polyA sequence that is 3' to all of the polycistronic cassettes. In embodiments, the polyA sequence that is 3' to all of the polycistronic cassettes is a SV40 pA having a nucleic acid sequence of SEQ ID NO: 162 or 119.

In embodiments, provided herein are nucleic acids comprising one or more polycistronic cassettes selected from the group consisting of: (a) a coagulation cassette comprising: (i) a first cistron encoding a THBD protein wherein the nucleic acid sequence encoding the THBD protein is selected from the group consisting of SEQ ID NOS: 97-102, 166, and 265-266; (ii) a second cistron encoding a TFPI protein wherein the nucleic acid sequence of encoding the TFPI protein is selected from the group consisting of SEQ ID NOS: 94-96, 103, and 187; (iii) a ssUBC promoter selected from SEQ ID NOS: 141, 168, 178; (iv) a hsGH poly A sequence selected from SEQ ID NOS. 113 and 161; (b) an innate immunity cassette comprising: (i) a first cistron encoding a B2M HLA-E fusion protein wherein the nucleic acid sequence encoding the B2M HLA-E fusion protein is selected from the group consisting of SEQ ID NOS: 62, 66, 105; (ii) a second cistron encoding a CD47 protein wherein the nucleic acid sequence encoding the CD47 protein is selected from the group consisting of SEQ ID NOS: 77-83, 180, and 259; (iii) a ssHSPA8 promoter selected from SEQ ID NOS: 139-140, 142-145; and (iv) a btGH poly A sequence selected from SEQ ID NOS. 112, 120-122, 159, 190; and (c) a complement regulation cassette comprising: (i) a first cistron encoding a CD46 protein wherein the nucleic acid sequence encoding the CD46 protein is selected from the group consisting of SEQ ID NOS: 71-76, 185, 200, and 253-258; (ii) a second cistron encoding a CD55 protein wherein the nucleic acid sequence encoding the CD55 protein is selected from the group consisting of SEQ ID NOS: 84, 85, 107, and 184; (iii) a CAG promoter selected from SEQ ID NOS: 126-128; and (iv) a hsHBB poly A sequence selected from SEQ ID NOS. 114-116 and 191. In embodiments, a UCOE separates the innate immunity cassette from the complement regulation cassette. In embodiments, the UCOE has a sequence selected from SEQ ID NOS: 19-22, 157, and 193. In embodiments, the nucleic acid comprises a polyA sequence that is 5' to all of the polycistronic cassettes. In embodiments, the polyA sequence that is 5' to all of the polycistronic cassettes is a btHBB pA having a nucleic acid sequence of SEQ ID NO: 160. In embodiments, the nucleic acid comprises a polyA sequence that is 3' to all of the polycistronic cassettes. In embodiments, the polyA sequence that is 3' to all of the polycistronic cassettes is a SV40 pA having a nucleic acid sequence of SEQ ID NO: 162 or 119.

In embodiments, provided herein are nucleic acids comprising one or more polycistronic cassettes selected from the group consisting of: (a) a coagulation cassette comprising: (i) a first cistron encoding a THBD protein wherein the nucleic acid sequence encoding the THBD protein is selected from the group consisting of SEQ ID NOS: 97-102, 166, and 265-266; (ii) a second cistron encoding a TFPI protein wherein the nucleic acid sequence of encoding the TFPI protein is selected from the group consisting of SEQ ID NOS: 94-96, 103, and 187; (iii) a ssUBC promoter selected from SEQ ID NOS: 141, 168, 178; (iv) a hsGH poly A sequence selected from SEQ ID NOS. 113 and 161; (b) an innate immunity cassette comprising: (i) a first cistron encoding a B2M HLA-E fusion protein wherein the nucleic acid sequence encoding the B2M HLA-E fusion protein is selected from the group consisting of SEQ ID NOS: 62, 66, 105; (ii) a second cistron encoding a CD47 protein wherein the nucleic acid sequence encoding the CD47 protein is selected from the group consisting of SEQ ID NOS: 77-83, 180, and 259; (iii) a ssHSPA8 promoter selected from SEQ ID NOS: 139-140, 142-145; and (iv) a btGH poly A sequence selected from SEQ ID NOS. 112, 120-122, 159, 190; (c) a complement regulation cassette comprising: (i) a first cistron encoding a CD46 protein wherein the nucleic acid sequence encoding the CD46 protein is selected from the group consisting of SEQ ID NOS: 71-76, 185, 200, and 253-258; (ii) a second cistron encoding a CD55 protein wherein the nucleic acid sequence encoding the CD55 protein is selected from the group consisting of SEQ ID NOS: 84, 85, 107, and 184; (iii) a CAG promoter selected from SEQ ID NOS: 126-128; and (iv) a ocHBB poly A sequence having the nucleic acid sequence of SEQ ID NO: 192; and (d) a inflammation and apoptosis cassette comprising: (i) a first cistron encoding an A20 protein wherein the nucleic acid sequence of A20 is selected from the group consisting of SEQ ID NOS: 64-65, 104, 182, and 188; (ii) a second cistron encoding a HO1 protein wherein the nucleic acid sequence of HO1 is selected from the group consisting of SEQ ID NOS: 63, 109, 165, 183, and 189; (iii) a ssEEF1α1 promoter selected from SEQ ID NOS: 136-138, 179; and (iv) a hsHBB poly A sequence selected from SEQ ID NOS. 114-116 and 191. In embodiments, a UCOE separates the innate immunity cassette from the complement regulation cassette. In embodiments, the UCOE has a sequence selected from SEQ ID NOS: 19-22, 157, and 193. In embodiments, the nucleic acid comprises a polyA sequence that is 5' to all of the polycistronic cassettes. In embodiments, the polyA sequence that is 5' to all of the polycistronic cassettes is a btHBB pA having a nucleic acid sequence of SEQ ID NO: 160. In embodiments, the nucleic acid comprises a polyA sequence that is 3' to all of the polycistronic cassettes. In embodiments, the polyA sequence that is 3' to all of the polycistronic cassettes is a SV40 pA having a nucleic acid sequence of SEQ ID NO: 162 or 119.

III. Cells, Tissues, Organs, and Animals

Porcine xenografts are broadly compatible with human organ size and physiology and are ethically acceptable to the US general population. However, xenotransplanted porcine tissue elicits a complex series of events leading to graft rejection including: hyperacute rejection due to the presence of preformed antibodies to pig antigens, complement activation and hypercoagulability, and heightened innate and adaptive immune responses due to molecular incompatibilities. The present disclosure uses genetic engineering approaches to address current shortcomings of xenotransplantation.

In particular, a number of immunological and functional challenges exist involving innate and adaptive immune function. Complement- and coagulation-mediated dysfunction arises due to molecular incompatibility between the donor porcine tissue and human physiology and leads to acute xenograft failure. Pre-formed antibodies to α-1,3-galactosyl-galactose (αGal) epitopes initiate hyperacute graft rejection through activation of complement. Genetic inactivation of the glycoprotein GGTA1 can reduce this rapid graft destruction. Protection is further improved through over-expression of genes for human complement regulatory proteins (hCRPs) CD46 (membrane cofactor protein), CD55 (complement decay accelerating factor), and CD59 (MAC-inhibitory protein).

Most non-Gal xenoantibodies recognize the sialic acid N-glycolylneuraminic acid (Neu5Gc) which is synthesized by the CMAH protein. This gene is inactive in humans and, as such, porcine Neu5Gc is immunogenic in humans. Therefore, porcine CMAH likely must be inactivated for clinical success in xenotransplantation. While expression of complement regulators and knockout of GGTA1 reduces hyperacute rejection, these genetic modifications do not impact acute vascular rejection (AVR).

Coagulation dysfunction, including thrombotic microangiopathy and systemic consumptive coagulopathy, has persisted even with knockout of GGTA1 and overexpression of hCRP due primarily to molecular incompatibilities in the coagulation system between pig and non-human primates (NHP).

Despite attempts by others to generate transgenic pigs for safe xenotransplantation, these transgenic pigs carried only a limited number of transgenes due to construct capacity constraints and transcription interference between transgenes. These methods proved insufficient to overcome xenograft incompatibility. For example, US Patent Publ. No. 2018/0249688 utilized multi-cistronic expression vectors with different combinations of transgenes. Importantly, these multi-cistronic vectors comprised only 4 transgenes and were used to produce pigs having 6 genetic modifications, including KO of alpha Gal (GTKO). In the present disclosure, a combination of KO, KI, and genomic replacement strategies are utilized. For the first time, PERV-free pigs have been produced expressing more than 6 transgenes from a single locus.

The examples described and disclosed herein provide a platform to achieve a greater number of genetic modifications within the same pig. From this work, porcine cells were genetically modified with more than six transgenes to generate immunologically compatible cells, tissues, organs, pigs, and progeny. Using CRISPR-Cas9, multiple genes were functionally knocked out, including GGTA1, CMAH, and β4GALNT2, to eliminate the glycans that are recognized by human preformed anti-pig antibodies. PiggyBAC mediated integration or CRISPR mediated integration was used to integrate one or more of the polycistronic cassettes described herein (e.g., a coagulation cassette, a complement regulation cassette, an innate immunity cassette, an innate immunity and inflammation and apoptosis cassette, a cell immunity and coagulation cassette, an apoptosis and coagulation cassette, an apoptosis and cell immunity cassette, an inflammation and apoptosis cassette, a complement regulation and innate immunity cassette, a complement regulation and inflammation and apoptosis cassette). Additionally, porcine endogenous retrovirus (PERV) genes of the porcine cell were knocked out via CRISPR-Cas9.

In embodiments, provided herein are cells comprising the polycistronic cassettes described herein. In embodiments, provided herein are cells comprising the nucleic acids described herein. In embodiments, the cells are porcine cells. In embodiments, the cells are primary porcine cells. In embodiments, the cells are clonal. In embodiments, clonal cells are selected and genotyped. Cells with the correct genotype are expanded to support pig cloning. Cells comprising one or more of the polycistronic cassettes described herein at a genomic safe harbor locus are cloned into a pig through somatic cell nuclear transfer. In embodiments, provided herein are genetically modified animals comprising cells comprising one or more of the polycistronic cassettes described herein. In embodiments, the genetically modified animal is bred with a non-genetically modified animal. In embodiments, the genetically modified animal is bred with another genetically modified animal. Provided herein are the progeny resulting from breeding a genetically modified animal with another genetically modified animal or a non-genetically modified animal. In embodiments, provided herein are cells, tissues, or organs from the progeny.

In embodiments, a porcine donor cell utilized to generate a transgenic pig is substantially PERV-free, exhibits knockout of GGTA1, CMAH, and β4GALNT2, exhibits knockin of one or more of the polycistronic cassettes described herein, or exhibits any combination of the aforementioned features.

The present disclosure provides cells, tissues, organs, and animals having multiple modified genes, and methods of generating the same. In embodiments, the cells, tissue, organs, are obtained from an animal, or is an animal. In embodiments, the animal is a mammal. In embodiments, the mammal is a non-human mammal. In embodiments, the non-human mammal is a horse, primate, pig, cattle, buffalo, bison, cow, sheep, goat, dog, or cat. In embodiments, the non-human mammal is an ungulate. In embodiments, the ungulate is a horse, rhinoceros, tapir, cattle, pig, giraffe, camel, deer, sheep, hippopotamus, whale, dolphin, or porpoise. In embodiments, the mammal is a porcine mammal.

Modification of genes in accordance with the present disclosure serves to improve molecular compatibility between the donor and the recipient and to reduce adverse events, including hyperacute rejection, acute humoral rejection, thrombotic microangiopathy, and chronic vasculopathy. For example, hyperacute rejection occurs in a very short time span, typically within minutes to hours after transplantation and results from pre-formed antibodies that activate complement and graft endothelial cells, in turn causing pro-coagulation changes that lead to hemostasis and eventually destruction of the grafted organ. In certain embodiments, the cells, tissues, organs, and animals generate a reduced hyperacute rejection.

In embodiments, the present disclosure provides for one or more cells, tissues, organs, or animals having multiple modified genes. In embodiments, the cell, tissue, organ, or animal has been genetically modified such that multiple genes have been added, deleted, inactivated, disrupted, a portion thereof has been excised, or the gene sequence has been altered. In embodiments, the cell, tissue, organ, or animal has from about 5 to about 20 modified genes, for example, about 5, about 6, about 7, about 8, about 9, about 10, about 11, about 12, about 13, about 14, about 15, about 16, about 17, about 18, about 19, or about 20 genes that have been modified. In embodiments, the 5, 6, 7, 8, 9, 10, 11, 12, 13, 14, 15, 16, 17, 18, 19, or 20 genes that have been modified are expressed from a single locus. In embodiments, the 5, 10, or 12 genes that have been modified are expressed from a single locus. In embodiments, the 12 genes that have been modified are expressed from a single locus. In embodiments, the cell, tissue, organ, or animal has more than 20, more than 15, more than 10, more than 5, more than 3, or more than 2 genes that have been modified. In embodiments, the cell, tissue, organ, or animal has more than 10, more than 5, more than 3, more than 2, or more than 1 gene that has been modified. In embodiments, the cell, tissue, organ, or animal has one copy of the modified gene and in other embodiments, the cell, tissue, organ, or animal has more than one copy of the one or more modified genes, such as more than 2, more than 3, more than 4, more than 5, more than 6, more than 7, more than 8, more than 9, more than 10, more than 15, more than 20, more than 25, more than 30, more than 35, more than 40, more than 50, more than 60, more than 70, more than 80, more than 90, or more than 100 copies of the modified gene. In embodiments, the cell has between 1 copy and about 100 copies, between 1 copy and about 90 copies, between 1 copy and about 80 copies, between 1 copy and about 70 copies, between 1 copy and about 60 copies, between 1 copy and about 50 copies, between 1 copy and about 40 copies, between 1 copy and about 30 copies, between about 5 copies and about 20 copies, between about 10 copies, and about 15 copies, between about 10 copies and about 15 copies, or between 1 copy and about 5 copies of one or more modified genes.

In embodiments, the present disclosure provides for one or more cells, tissues, organs, or animals having multiple copies of one or more of the modified genes. For example, the cells, tissues, organs, or animals may have 2, 3, 4, 5, 6, 7, 8, 9, about 10, about 15, about 20, about 25, about 30, or more of one or more of the modified genes.

In embodiments, the one or more cells is a primary cell. In embodiments, the one or more cells is a somatic cell. In embodiments, the one or more cells is a post-natal cell. In embodiments, the one or more cells is an adult cell (e.g., an adult ear fibroblast). In embodiments, the one or more cells is a fetal/embryonic cell (e.g., an embryonic blastomere). In embodiments, the one or more cells is a germ line cell. In embodiments, the one or more cells is an oocyte. In embodiments, the one or more cells is a stem cell. In embodiments, the one or more cells is a cell from a primary cell line. In embodiments, the one or more cells is selected from the group consisting of: an epithelial cell, a liver cell, a granulosa cell, a fat cell. In particular embodiments, the one or more cells is a fibroblast. In embodiments, the fibroblast is a female fetal fibroblast. In embodiments, the one or more cells is in vitro. In embodiments, the one or more cells is in vivo. In embodiments, the one or more cells is a single cell. In embodiments, the one or more cells is a member of a cell colony. In embodiments, the cell is an islet cell.

In embodiments, the one or more cells is a porcine cell. Non-limiting examples of the breeds a porcine cell originates from or is derived from includes any of the following pig breeds: American Landrace, American Yorkshire, Aksai Black Pied, Angeln saddleback, Appalachian English, Arapawa Island, Auckland Island, Australian Yorkshire, Babi Kampung, Ba Xuyen, Bantu, Basque, Bazna, Beijing Black, Belarus Black Pied, Belgian Landrace, Bengali Brown Shannaj, Bentheim Black Pied, Berkshire, Bisaro, Bangur, Black Slavonian, Black Canarian, Breitovo, British Landrace, British Lop, British Saddleback, Bulgarian White, Cambrough, Cantonese, Celtic, Chato Murciano, Chester White, Chiangmai Blackpig, Choctaw Hog, Creole, Czech Improved White, Danish Landrace, Danish Protest, Dermantsi Pied, Li Yan, Duroc, Dutch Landrace, East Landrace, East Balkan, Essex, Estonian Bacon, Fengjing, Finnish Landrace, Forest Mountain, French Landrace, Gascon, German Landrace, Gloucestershire Old Spots, Gottingen minipig, Grice, Guinea Hog, Hampshire, Hante, Hereford, Hezuo, Hogan Hog, Huntington Black Hog, Iberian, Italian Landrace, Japanese Landrace, Jeju Black, Jinhua, Kakhetian, Kele, Kemerovo, Korean Native, Krskopolje, Kunekune, Lamcombe, Large Black, Large Black-White, Large White, Latvian White, Leicoma, Lithuanian Native, Lithuanian White, Lincolnshire Curly-Coated, Livny, Malhado de Alcobaca, Mangalitsa, Meishan, Middle White, Minzhu, Minokawa Buta, Mong Cai, Mora Romagnola, Moura, Mukota, Mulefoot, Murom, Myrhorod, Nero dei Nebrodi, Neijiang, New Zealand, Ningxiang, North Caucasian, North Siberian, Norwegian Landrace, Norwegian Yorkshire, Ossabaw Island, Oxford Sandy and Black, Pakchong 5, Philippine Native, Pietrain, Poland China, Red Wattle, Saddleback, Semirechensk, Siberian Black Pied, Small Black, Small White, Spots, Surabaya Babi, Swabian-Hall, Swedish Landrace, Swallow Belied Mangalitza, Taihu pig, Tamworth, Thuoc Nhieu, Tibetan, Tokyo-X, Tsivilsk, Turopolje, Ukrainian Spotted Steppe, Ukrainian White Steppe, Urzhum, Vietnamese Potbelly, Welsh, Wessex Saddleback, West French White, Windsnyer, Wuzhishanm, Yanan, Yorkshire and Yorkshire Blue and White. In embodiments, the porcine cells are Yorkshire and Yucatan porcine cells.

In embodiments, the cells, tissues, organs or animals of the present disclosure have been genetically modified such that one or more genes has been modified by addition, deletion, inactivation, disruption, excision of a portion thereof, or a portion of the gene sequence has been altered.

In embodiments, the cells, tissues, organs or animals of the disclosure comprise one or more mutations that inactivate one or more genes. In embodiments, the cells, tissues, organs or animals comprise one or more mutations or epigenetic changes that result in decreased or eliminated expression of one or more genes having the one or more mutations. In embodiments, the one or more genes is inactivated by genetically modifying the nucleic acid(s) present in the cells, tissues, organs or animals. In embodiments, the inactivation of one or more genes is confirmed by means of an assay. In embodiments, the assay is an infectivity assay, reverse transcriptase PCR assay, RNA-seq, real-time PCR, or junction PCR mapping assay.

Specific Genotypes

To provide cells, tissues, organs and animals safe and effective for human clinical use, the cells, tissues, organs, and animals (e.g., donor pigs) of the present disclosure are genetically engineered to have enhanced complement (i.e., complement toxicity), coagulation, inflammatory (i.e., apoptosis/inflammation), immune (i.e., cellular toxicity), and/or immunomodulation systems that render them compatible in humans. Novel combinations of knockout (KO), knockin (KI) (alternately referred to herein as transgene (TG)), and/or genomic replacement strategies provide the enhanced complement, coagulation, inflammatory, immune, and/or immunomodulation systems. Expression of genes that render the porcine cells and organs compatible with human is evaluated using a variety of methods. Non-limiting examples of such methods include flow cytometry, immunohistochemistry, and RNA sequencing.

Cells, tissues, organs and animals lacking expression of major xenogenic carbohydrate antigens, for example by genetic KO, reduce or eliminate humoral rejection during xenotransplantation. Three of the major xenogenic carbohydrate antigens include those produced by the glycosyltransferases/glycosylhydrolases GGTA1, CMAH, and B4GALNT2. A purpose for the functional loss of these genes is to reduce and/or eliminate the binding of preformed anti-pig antibodies to the endothelium of the porcine grafts.

Insertion of key complement, coagulation, inflammatory, immune, and/or immunomodulation factors into one or more genomic loci, for example safe harbor genomic loci such as AAVS1, will aid in regulating the human complement system, and natural killer (NK), macrophage, and T cell function. Non-limiting examples include, overexpression by KI of hCD46, hCD55, and hCD59 to inhibit the human complement cascade; humanization of vWF to prevent unregulated platelet sequestration and thrombotic microangiopathy, for example, by humanizing the A1 domain and/or flanking regions of the porcine vWF sequence; KI of B2M-HLA-E SCT to provide protection against human NK cell cytotoxicity and humanization of porcine cells; and KI of CD47, CD39, THBD, TFPI, A20 to function as immunosuppressants, immunomodulators, and/or anticoagulants.

In embodiments, the cells, tissues, organs or animals of the present disclosure have been genetically modified such that one or more genes or portions thereof has been modified by addition, deletion, inactivation, disruption, excision of a portion thereof. In embodiments, the present disclosure provides an isolated cell, tissue, organ, or animal having multiple modified genes. In embodiments, the modified genes include one or more of alpha GGTA1, β4GalNT2, CMAH, THBD, TFPI, CD39, HO1, CD46, CD55, CD59, major histocompatibility complex, class I, E single chain trimer (HLA-E SCT), A20, PD-L1, CD47, swine leukocyte antigen 1 (SLA-1), SLA-2, SLA-3, vWF, B2M, DQA, DRA, PROCR, B2M, HLA-E, CTLA-4 (e.g., LEA29Y), and XIAP.

In embodiments, the modified genes are GGTA1, B4GalNT2, CMAH, or any combination thereof. In embodiments, the GGTA1, B4GalNT2, and/or CMAH are genetically KO. In embodiments, the modified genes are MHC-I genes SLA-1, SLA-2, and SLA-3, MHC-II genes DQA and DRA, endogenous vWF, CD9, asialoglycoprotein receptor, at least one complement inhibitor gene (e.g., C3, CD46, CD55, and CD59), and any combination thereof. In embodiments the CD46, CD55 and/or CD59 are genetically KI.

In one embodiment, the cells, tissues, organs or animals of the present disclosure have been genetically modified with a transgene expression vector comprising CD46, CD55, CD59, THBD, TFPI, EPCR, CD39, B2M, HLA-E, CD47, A20, PD-L1, HO1, CTLA-4 (e.g., LEA29Y), XIAP, or any combination thereof. In one embodiment, the cells, tissues, organs or animals of the present disclosure have been further genetically modified to have reduced or no expression of GGTA1, B4GalNT2, CMAH, or any combination thereof, for example by genetic KO.

The cells, tissues, organs or animals of the present disclosure can be genetically modified by any method. In embodiments, the cells, tissues, organs, or animals of the present disclosure are modified using nucleic acids comprising multiple polycistronic cassettes. Non-limiting examples of suitable methods for the knockout (KO), knockin (KI), and/or genomic replacement strategies disclosed and described herein include CRISPR-mediated genetic modification using Cas9, Cas12a (Cpf1), or other CRISPR endonucleases, Argonaute endonucleases, transcription activator-like (TAL) effector and nucleases (TALEN), zinc finger nucleases (ZFN), expression vectors, transposon systems (e.g., PiggyBac transposase), or any combination thereof.

The cells, tissues, organs or animals of the present disclosure can be PERV-free. For example, the cells, tissues, organs or animals of the present disclosure may have PERV copies functionally deleted from their genome. The cells, tissues, organs or animals of the present disclosure may have PERV copies functionally inactivated in their genome. PERVs represent a risk factor if porcine cells, tissues, or organs were to be transplanted into human recipients. PERVs are released from normal pig cells and are infectious. PERV-A and PERV-B are polytropic viruses infecting cells of several species, among them humans (e.g. they are xenotropic); whereas PERV-C is an ecotropic virus infecting only pig cells. Non-limiting methods for functionally deleted PERV copies are disclosed and described in Niu 2017 and WIPO Publ. No. WO2018/195402, both of which are incorporated by reference herein in their entireties. In embodiments, the pigs are genetically engineered to be PERV-A, PERV-B, or PERV-C (or any combination thereof) free.

In embodiments, additional genes of cells, tissues, organs or animals of the present disclosure are modified by addition, deletion, inactivation, disruption, excision of a portion thereof, or a portion of the gene sequence. In embodiments, the modification comprises deleting one or more of the following genes: MHC-I genes SLA-1, SLA-2, and SLA-3, MHC-II genes DQA and DRA, endogenous vWF, CD9, asialoglycoprotein receptor, and C3, and expressing one or more of the following transgenes: PD-L1, exogenous vWF, HLA-E, HLA-G, B2M, and CIITA-DN. In embodiments, the modification comprises deleting one or more of the following genes: alpha galactosyltransferase 1, GGTA1, β4GALN2, and CMAH, and expressing one or more of the following transgenes: CD46, CD55, CD59, CD47, HO1, A20, TNFR1-Ig, CD39, THBD, TFPI, EPCR, PD-1, CTLA-4 (e.g., LEA29Y), CD73, SOD3, CXCL12, FasL, CXCR3, CD39L1, GLP-1R, M3R, IL35, IL12A and EB13. In embodiments, the modified genes are CD46, CD55, CD59, CD47, HO1, A20, TNFR1-Ig, CD39, THBD, TFPI, EPCR, PD-1, CTLA-4 (e.g., LEA29Y), CD73, SOD3, CXCL12, FasL, CXCR3, CD39L1, GLP-1R, M3R, IL35, IL12A and EB13.

In embodiments, the cells, tissues, organs or animals of the present disclosure comprise one or more genetically modified genes. A genetically modified gene may contain an addition of one or more nucleotides, a deletion of one or more nucleotides, or mutation of one or more nucleotides. In embodiments, the genetically modified gene is disrupted. In embodiments, transcription and/or translation of the genetically modified gene is disrupted. In embodiments, the genetically modified gene is inactivated. In embodiments, the cells, tissues, organs, or animals comprise a transgene or a portion thereof that was not present in the wild-type cells, tissues, organs, or animals. In embodiments, the transgene is an exogenous gene. In embodiments, the transgene is an endogenous gene. In embodiments, the cells, tissues, organs, or animals of the present disclosure comprise one or more nucleic acids comprising one or more polycistronic cassettes as described herein.

In embodiments, the modified genes are MHC Class I genes. In embodiments, the modified MHC Class I genes include one or more of the following SLA-1, SLA-2, SLA-3, and B2M. In embodiments, the modified genes are SLA-1, SLA-2, and/or SLA-3. In embodiments, the modified gene is B2M. In embodiments, the modified MHC Class I genes include one or more of the following SLA-1, SLA-2, SLA-3, and B2M. In embodiments, the modified B2M, SLA-1, SLA-2, and/or SLA-3 genes, and/or a portion thereof, are replaced with a human HLA-E gene, a human HLA-G gene, a human B2M gene, and/or a human (dominant-negative mutant class II transactivator) CIITA-DN gene, and/or a portion thereof. In embodiments, the modified genes are conditionally and/or inducibly modified. In embodiments, a conditional promoter and/or an inducible promoter is used to conditionally and/or inducibly modify the one or more modified genes. In embodiments, provided herein are isolated cells, tissues, organs, or animals comprising B2M, SLA-1, SLA-2, or SLA-3 genes, or any combination of genes thereof, that are conditionally altered and replaced with at least a portion of a human HLA-E gene, a human HLA-G gene, a human B2M gene, and/or a human CIITA-DN gene.

In embodiments, provided herein are cells, tissues, organs, or animals comprising modified MHC Class II genes. In embodiments, the modified MHC Class II genes are DRQ, DRA, or any combination thereof. A genetically modified MHC Class II gene may contain an addition of one or more nucleotides, a deletion of one or more nucleotides, or mutation of one or more nucleotides. In embodiments, the genetically modified MHC Class II gene is disrupted. In embodiments, transcription and/or translation of the genetically modified MHC Class II gene is disrupted. In embodiments, the genetically modified MHC Class II gene is inactivated. In embodiments, the cells, tissues, organs, or animals comprise a MHC Class II transgene or a portion thereof that was not present in the wild-type cells, tissues, organs, or animals. In embodiments, the modified genes are conditionally and/or inducibly modified. In embodiments, a conditional promoter and/or an inducible promoter is used to conditionally and/or inducibly modify the one or more modified genes. In embodiments, the isolated cell, tissue, organ, or animal comprises conditionally altering DRQ and/or DRA genes, or any combination thereof.

In embodiments, provided herein are cells, tissues, organs, or animals comprising a modified vWF gene and/or vWF-related genes. A genetically modified vWF gene and/or vWF-related gene may contain an addition of one or more nucleotides, a deletion of one or more nucleotides, or mutation of one or more nucleotides. In embodiments, the genetically modified vWF gene and/or vWF-related gene is disrupted. In embodiments, transcription and/or translation of the genetically modified vWF gene and/or vWF-related gene is disrupted. In embodiments, the genetically modified vWF gene and/or vWF-related gene is inactivated. In embodiments, the cells, tissues, organs, or animals comprise a vWF gene and/or vWF-related gene transgene or a portion thereof that was not present in the wild-type cells, tissues, organs, or animals. In embodiments, the modified vWF gene, and/or a portion thereof, is replaced with a human vWF gene and/or a portion thereof. In embodiments, the modified vWF gene, modified vWF-related genes, and/or a portion(s) thereof, is replaced with a human vWF gene, one or more human vWF-related genes, and/or a portion thereof. In embodiments, the modified vWF gene and/or vWF-related genes are conditionally and/or inducibly modified. In embodiments, a conditional promoter and/or an inducible promoter is used to conditionally and/or inducibly modify the one or more modified genes. In embodiments, the isolated cell, tissue, organ, or animal comprises conditionally altering vWF, vWF-related genes, a portion(s) thereof, or any combination thereof, and replacing the conditionally altered genes with the human vWF gene, at least a portion of the human vWF gene, one or more other human vWF-related genes, at least a portion of one or more human vWF-related genes, or any combination thereof. In embodiments, the vWF gene is modified using gRNAs designed to initiate the HDR replacement in the endogenous porcine genome and cut near the region to be replaced by the human sequences.

In embodiments, provided herein are cells, tissues, organs, or animals comprising one or more modified complement genes. In embodiments, the complement gene is C3. A genetically modified complement gene may contain an addition of one or more nucleotides, a deletion of one or more nucleotides, or mutation of one or more nucleotides. In embodiments, the genetically modified complement gene is disrupted. In embodiments, transcription and/or translation of the genetically modified complement gene is disrupted. In embodiments, the genetically modified complement gene is inactivated. In embodiments, the cells, tissues, organs, or animals comprise complement gene or a portion thereof that is not present in the wild-type cells, tissues, organs, or animals. In embodiments, the modified C3 gene and/or complement genes are conditionally and/or inducibly modified. In embodiments, a conditional promoter and/or an inducible promoter is used to conditionally and/or inducibly modify the one or more modified genes. In embodiments, the isolated cell, tissue, organ, or animal comprises conditionally altering C3, complement genes, a portion(s) thereof, or any combination thereof. In embodiments, the C3 gene is modified using gRNAs.

In embodiments, the modified gene is a knockout of C3. In embodiments, the modified gene is a knock-in of PD-L1. In embodiments, the modified gene is a humanized vWF of the porcine vWF. In embodiments, the modified gene is a conditional knock-in of MHC-I genes SLA-1, SLA-2, and SLA-3.

In embodiments, no or substantially no immune response is elicited by the host against the genetically modified cell, tissue or organ.

In embodiments, the disclosure provides for nucleic acids obtained from any of the cells disclosed herein. In embodiments, the nucleic acid(s) in the cell are genetically modified such that one or more genes in the cell are altered or the genome of the cell is otherwise modified. In embodiments, the genes, or portions thereof, that are genetically modified using any of the genetic modifications systems known in the art and/or disclosed herein. In embodiments, the genetic modification system is a TALEN, a zinc finger nuclease, and/or a CRISPR-based system. In embodiments, the genetic modification system is a CRISPR-Cas9 system. In embodiments, the genetic modification system is a Class II, Type-II CRISPR system. In embodiments, the genetic modification system is a Class II, Type-V CRISPR system. In embodiments, the cell is genetically modified such that one or more genes or portions thereof in the cell are inactivated, and the cell is further genetically modified such that the cell has reduced expression of one or more genes, or portions thereof, that would induce an immune response if the cell (or a tissue or organ cloned/derived from the cell) were transplanted to a human. In embodiments, the cell is genetically modified to have increased expression of one or more human genes, or portions thereof. In embodiments, the cell is genetically modified to have increased expression of one or more humanized genes, or portions thereof. In embodiments, the cell is genetically modified such that one or more genes, or portions thereof, in the cell are inactivated, and the cell is further genetically modified such that the cell has increased expression of one or more genes that would suppress an immune response if the cell (or a tissue or organ cloned/derived from the cell) were transplanted to a human. In embodiments, the cell is genetically modified such that one or more genes, or portions thereof, in the cell are inactivated, and the cell is further genetically modified such that the cell has reduced expression of one or more genes that would induce an immune response if the cell (or a tissue or organ cloned/derived from the cell) were transplanted to a human, and the cell is further genetically modified such that the cell has increased expression of one or more genes that would suppress an immune response if the cell (or a tissue or organ cloned/derived from the cell) were transplanted to a human.

In embodiments, the disclosure provides for an embryo that was cloned from the genetically modified cell. The following reference describes producing an embryo from a genetically modified cell and is incorporated by reference herein in its entirety: Kim et al. (2016). PLoS ONE: 11(7): e0160289. In embodiments, the genetically modified nucleic acid(s) are extracted from the genetically modified cell and cloned into a different cell. For example, in somatic cell nuclear transfer, the genetically modified nucleic acid from the genetically modified cell is introduced into an enucleated oocyte. In embodiments, oocytes can be enucleated by partial zona dissection near the polar body and then pressing out cytoplasm at the dissection area. In embodiments, an injection pipette with a sharp beveled tip is used to inject the genetically modified cell into an enucleated oocyte arrested at meiosis 2. Oocytes arrested at meiosis-2 are frequently termed "eggs." In embodiments, an embryo is generated by fusing and activating the oocyte. In embodiments, oocytes are fused by delivering an electric pulse to the oocytes. Such an embryo may be referred to herein as a "genetically modified embryo." In embodiments, the genetically modified embryo is activated by treatment with 6-dimethylaminopurine (6-DMAP), ionomycin or a combination thereof. In embodiments, the genetically modified embryo is treated with a histone deacetylase inhibitor (HDACi). In embodiments, the genetically modified embryo is transferred to the oviducts of a recipient female pig. In embodiments, the genetically modified embryo is transferred to the oviducts of a recipient female pig 12 hours to 4 days after activation. For example, the genetically modified embryo is transferred to the oviducts of a recipient female pig about 12 hours, about 13 hours, about 14 hours, about 15 hours, about 16 hours, about 17 hours, about 18 hours, about 19 hours, about 20 hours, about 21 hours, about 22 hours, about 23 hours, about 24 hours, about 1.25 days, about 1.5 days, about 1.75 days, about 2 days, about 2.25 days, about 2.5 days, about 2.75 days, about 3 days, about 3.25 days, about 3.5 days, about 3.75 days, or about 4 days after activation. In embodiments, the genetically modified embryo is transferred to the oviducts of a recipient female pig 20 to 24 hours after activation. See, e.g., Cibelli 1998 and U.S. Pat. No. 6,548,741. In embodiments, recipient females are checked for pregnancy approximately 20-21 days after transfer of the genetically modified embryo.

In embodiments, the genetically modified embryo is grown into a post-natal genetically modified animal. In embodiments, the post-natal genetically modified animal is a neo-natal genetically modified animal. In embodiments, the genetically modified pig is a juvenile genetically modified animal. In embodiments, the genetically modified animal is an adult genetically modified animal (e.g., older than 5-6 months). In embodiments, the genetically modified animal is a female genetically modified animal. In embodiments, the animal is a male genetically modified animal. In embodiments, the genetically modified animal is bred with a non-genetically modified animal. In embodiments, the genetically modified animal is bred with another genetically modified animal. In embodiments, the genetically modified pig is bred with another genetically modified animal that has reduced or no active virus. In embodiments, the genetically modified animal is bred with a second genetically modified animal that has been genetically modified such that the cells, tissues or organs from the second genetically modified animal are less likely to induce an immune response if transplanted to a human.

In embodiments the genetically modified animal is an animal having one or more modified genes and maintains a same or similar level of expression or inactivation of the modified gene(s) for at least a month, at least 6 months, at least 1 year, at least 5 years, at least 10 years post-gestation. In embodiments, the genetically modified animal remains genetically modified having one or more modified genes as a genetically modified pig even after delivery from a non-viral-inactivated surrogate or after being in a facility/space with other non-viral-inactivated animals.

In embodiments, the disclosure provides for cells, tissues, or organs obtained from any of the post-natal genetically modified pigs described herein. In embodiments, the cell, tissue, or organ is selected from the group consisting of liver, kidney, lung, heart, pancreas, muscle, blood, and bone. In particular embodiments, the organ is liver, kidney, lung or heart. In embodiments, the cell from the post-natal genetically modified pig is selected from the group consisting of: pancreatic islets, lung epithelial cells, cardiac muscle cells, skeletal muscle cells, smooth muscle cells, hepatocytes, non-parenchymal liver cells, gall bladder epithelial cells, gall bladder endothelial cells, bile duct epithelial cells, bile duct endothelial cells, hepatic vessel epithelial cells, hepatic vessel endothelial cells, sinusoid cells, choroid plexus cells, fibroblasts, Sertoli cells, neuronal cells, stem cells, and adrenal chromaffin cells. In embodiments, the genetically modified organs, tissues or cells have been separated from their natural environment (i.e., separated from the pig in which they are being grown). In embodiments, separation from the natural environment means a gross physical separation from the natural environment, e.g., removal from the genetically modified donor animal, and alteration of the genetically modified organs', tissues' or cells' relationship with the neighboring cells with which they are in direct contact (e.g., by dissociation).

IV. Methods of Generating Cells, Tissues, Organs, or Animals

The disclosure provides for methods of generating cells, tissues, organs, or animals having one or more of the nucleic acids comprising one or more polycistronic cassettes described herein. In embodiments, the disclosure provides a method of inactivating, deleting, or otherwise disrupting one or more genes, or portions thereof, in any of the cells disclosed herein, comprising administering to the cell a gene editing agent specific to a gene, wherein the agent disrupts transcription and/or translation of the gene. In embodiments, the agent targets the start codon of the gene and inhibits transcription of the gene. In embodiments, the agent targets an exon in the gene and the agent induces a frameshift mutation in the gene. In embodiments, the agent introduces an inactivating mutation into the gene. In embodiments, the agent represses transcription of the gene.

In embodiments, the disclosure provides a method of altering one or more genes, or a portion thereof, in vivo, comprising administering to the cell a gene editing agent specific to a gene, wherein the agent alters a sequence of the gene, such as by humanizing the gene or otherwise changing a native (e.g., wild-type) sequence of the gene.

In embodiments, the disclosure provides a method of expressing one or more nucleic acids comprising one or more polycistronic cassettes, or a portion thereof, comprising administering to a cell a gene editing agent comprising one or more polycistronic cassettes, or a portion thereof, wherein the agent introduces a sequence of the nucleic acid comprising one or more polycistronic cassettes. In embodiments, the agent is a nucleic acid sequence, such as a plasmid, a vector, or the like. In embodiments, the nucleic acid sequence includes one or more nucleic acid sequences, such as a promoter, a transgene, and/or additional genes. In embodiments, the nucleic acid sequence, or a portion thereof, is derived from one or more species and/or one or more sources. In embodiments, the species is a species that will receive the genetically modified cell, tissue, or organ. In embodiments, the species is a human. In other embodiments, the species is non-human, such as a mammal, an animal, a bacteria, and/or a virus.

In embodiments, any of the agents disclosed herein is a polynucleotide. In embodiments, the polynucleotide encodes one or more of the nucleases and/or nickases and/or RNA or DNA molecules described herein. In embodiments, the polynucleotide agent is introduced to one or more cells. In embodiments, the polynucleotide is introduced to the one or more cells in a manner such that the polynucleotide is transiently expressed by the one or more cells. In embodiments, the polynucleotide is introduced to the one or more cells in a manner such that the polynucleotide is stably expressed by the one or more cells. In embodiments, the polynucleotide is introduced in a manner such that it is stably incorporated in the cell genome. In embodiments, the polynucleotide is introduced along with one or more transposable elements. In embodiments, the transposable element is a polynucleotide sequence encoding a transposase. In embodiments, the transposable element is a polynucleotide sequence encoding a PiggyBac transposase. In embodiments, the transposable element is inducible. In embodiments, the transposable element is doxycycline-inducible. In embodiments, the polynucleotide further comprises a selectable marker. In embodiments, the selectable marker is a puromycin-resistant marker. In embodiments, the selectable marker is a fluorescent protein (e.g., GFP).

In embodiments, the agent is a nuclease or a nickase that is used to target DNA in the cell. In embodiments, the agent specifically targets and suppresses expression of a gene. In embodiments, the agent comprises a transcription repressor domain. In embodiments, the transcription repressor domain is a Kruppel associated box (KRAB).

In embodiments, the agent is any programmable nuclease. In embodiments, the agent is a natural homing meganuclease. In embodiments, the agent is a TALEN-based agent, a ZFN-based agent, or a CRISPR-based agent, or any biologically active fragment, fusion, derivative or combination thereof. CRISPR-based agents include, for example, Class II Type II and Type V systems, including e.g. the various species variants of Cas9 and Cpf1. In embodiments, the agent is a deaminase or a nucleic acid encoding a deaminase. In embodiments, a cell is genetically engineered to stably and/or transiently express a TALEN-based agent, a ZFN-based agent, and/or a CRISPR-based agent.

In embodiments, any of the nucleic acids or fragments thereof described herein are integrated into the genome of a host cell. The nucleic acid may be integrated into the cell via recombinase-mediated cassette exchange, PiggyBac transposon-mediated gene transfer, CRISPR-mediated homology dependent recombination, or CRISPR-mediated homology-independent targeted integration.

In embodiments, any of the nucleic acids or fragments thereof described herein are integrated into a host cell at a genomic safe harbor locus comprising a landing pad. FIG. 28A and FIG. 28C provide exemplary landing pads. Non-limiting examples of genomic safe harbor loci include AAVS1, CCR5, and Fos5. In embodiments, the landing pad is inserted into intron 1 of the AAVS1 site. In embodiments, the landing pad is introduced into the 3' flanking region of the AAVS1 site. In embodiments, the landing pad comprises an Ank2 gene, a Cpsf4 gene, a C-Mos gene, a Fos1 gene, or an adeno-associated virus integration site (AAVS). U.S. Pat. No. 8,980,579 describes chromosomal landing pads and is incorporated by reference herein in its entirety. In embodiments, the landing pad comprises an adeno-associated virus integration site (AAVS) or a Fos1 gene. In embodiments, the landing pad comprises an insulator sequence (e.g. HS4). In embodiments, the landing pad comprises one or more loxP sites. In embodiments, the landing pad comprises two loxP sites. In embodiments, the landing pad comprises a polyA sequence. In embodiments, the poly A sequence comprises a terminator. In embodiments, the landing pad comprises a marker, such as blue fluorescent protein (BFP). In embodiments, the landing pad comprises a promoter. In embodiments, the promoter comprises any one of the sequences in Table B. In embodiments, the poly A sequence comprises any one of the sequences in Table C. In embodiments, from 5' to 3', the landing pad comprises a first insulator sequence, a loxP site, a promoter, a fluorescent protein, a poly A sequence, a second loxP site, a second insulator site, and a poly A sequence. In embodiments, from 5' to 3', the landing pad comprises a first loxP site, a promoter, a fluorescent protein, a poly A sequence, and a second loxP site. In embodiments, the landing pad comprises a nucleic acid sequence of SEQ ID NO: 248 or 249.

In embodiments, a landing pad is integrated into the genomic safe harbor locus via recombinase mediated cassette exchange. In embodiments, a landing pad is integrated into the genomic safe harbor locus via CRISPR-Cas9 homology directed repair (HDR).

In embodiments, provided herein is a cell, organ, or tissue comprising a landing pad. In embodiments, provided herein is a cell, organ, or tissue comprising a landing pad comprising the nucleic acid sequence of SEQ ID NO: 248 or 249.

In embodiments, after a landing pad is introduced to a cell, the polycistronic cassettes of any one of FIGS. 1A-1D, 2A-2J, 3A-3C, 4A-4H, FIGS. 5A-5F, or FIG. 6 are introduced into the cell. In embodiments, the polycistronic cassettes of any one of FIGS. 1A-1D, 2A-2J, 3A-3C, 4A-4H, FIGS. 5A-5F, or FIG. 6 replace the poly A sequence and marker gene of the landing pad. Integration of the polycistronic cassettes may be performed using recombinase mediated cassette exchange or CRISPR-Cas9 HDR. FIG. 28B provides an illustration of integration of the 15S5 payload (see FIG. 2I) into the landing pad of FIG. 28A. In embodiments, a nucleic acid that is integrated into the genomic safe harbor locus comprises sequences homologous to the genomic integration site at the 5' and 3' end of the nucleic acid. In embodiments, a nucleic acid comprising the polycistronic cassettes of any one of FIGS. 1A-1D, 2A-2J, 3A-3C, 4A-4H, FIGS. 5A-5F, or FIG. 6 comprises sequences homologous to the genomic integration site at the 5' and 3' end of the nucleic acid.

In embodiments, provided herein is a method of generating a genetically modified cell comprising (i) knocking out GGTA1, CMAH, and β4GALNT2; (ii) knocking out of one or more PERV elements (e.g., PERV pol, env, gag genes, or a combination thereof); (iii) knocking in any one or more polycistronic cassettes described herein. The aforementioned method may be performed in any one of the following orders: (i), (ii), (iii); (i), (iii), (ii); (ii), (i), (iii); (ii), (iii), (i); (iii), (i), (ii); or (iii), (ii), (i). In embodiments, a tissue, organ, or animal comprises a cell that is produced according to any of the aforementioned methods. In embodiments, the cell is a porcine cell. In embodiments, the cell is a primary porcine cell. In embodiments, the cell is a human cell.

V. Methods of Treatment

In embodiments, any of the genetically modified cells, tissues or organs disclosed herein may be used to treat a subject of a different species as the genetically modified cells. In embodiments, the disclosure provides for methods of transplanting any of the genetically modified cells, tissues or organs described herein into a subject in need thereof. In embodiments, the subject is a human. In embodiments, the subject is a non-human primate. In embodiments, the subject is a pig, an ape, a human, a dog, a cat, a monkey, a lemur, a chimpanzee, a bonobo, an orangutan, a gibbons, a cow, a horse, a bird, a sheep, or a gorilla.

In embodiments, a genetically modified organ for use in any of the methods disclosed herein may be selected from the heart, lung, liver, eye, pituitary, thyroid, parathyroid, esophagus, thymus, adrenal glands, appendix, bladder, gallbladder, small intestine, large intestine, small intestine, kidney, pancreas, spleen, stomach, skin, and/or prostate, of the genetically modified pig. In embodiments, a genetically modified tissue for use in any of the methods disclosed herein may be selected from cartilage (e.g., esophageal cartilage, cartilage of the knee, cartilage of the ear, cartilage of the nose), muscle such as, but not limited to, smooth and cardiac (e.g., heart valves), tendons, ligaments, bone (e.g., bone marrow), cornea, middle ear and veins of the genetically modified pig. In embodiments, a genetically modified cell for use in any of the methods disclosed herein includes blood cells, skin follicles, hair follicles, and/or stem cells. Any portion of an organ or tissue (e.g., a portion of the eye such as the cornea) may also be administered the compositions of the present disclosure.

In embodiments, a heart, lung, liver, kidney, pancreas, or spleen is isolated from a pig that has been genetically modified to comprise (a) deletions or disruptions of GGTA1, CMAH, and B4GALNT2; (b) addition of CD46, CD55, CD59, THBD, TFPI, PROCR, CD39, B2M, HLA-E, CD47, A20, PD-L1, HO1, CTLA-4 (e.g., LEA29Y), XIAP, and combinations thereof (e.g. human or humanized copies thereof) expressed from a single multi-transgene cassette in the pig genome; and (c) functional deletion of all PERV copies. In embodiments, a heart, lung, liver, kidney, pancreas, or spleen is isolated from a pig that has been genetically modified to comprise (a) functional disruption of GGTA1, CMAH, and B4GALNT2; (b) addition of CD46, CD55, CD59, THBD, TFPI, PROCR, CD39, B2M, HLA-E, CD47, A20, PD-L1, HO1, CTLA-4 (e.g., LEA29Y), XIAP transgenes and combinations thereof (e.g. humanized copies thereof) expressed from a single multi-transgene cassette in the pig genome; and (c) functional inactivation of all PERV copies. In certain embodiments, the pig has been further genetically modified to have humanized vWF, deletion of ASGR1, and/or deletion of B2M genes.

In embodiments, prior to transplant, an organ is stored at a temperature between 2° C. and about 37° C. For example, in embodiments, an organ is stored at a temperature of about 2° C., about 3° C., about 4° C., about 5° C., about 6° C., about 7° C., about 8° C., about 9° C., about 10° C., about 11° C., about 12° C., about 13° C., about 14° C., about 15° C., about 16° C., about 17° C., about 18° C., about 19° C., about 20° C., about 21° C., about 22° C., about 23° C., about 24° C., about 25° C., about 26° C., about 27° C., about 28° C., about 29° C., about 30° C., about 31° C., about 32° C., about 33° C., about 34° C., about 35° C., about 36° C., or about 37° C. In embodiments, an organ is stored at a temperature from about 2° C. to about 8° C., at a temperature from about 4° C. to about 8° C., or from about 20° C. to about 25° C. In embodiments, prior to transplant, an organ is stored on ice.

In embodiments, prior to transplant, an organ is stored in an organ preservation solution. In embodiments, an organ preservation solution contains histidine, tryptophan, ketoglutarate, sodium chloride, human serum albumin, dextran 40, glucose, mannitol, sucrose, citrate, hydroxyethyl-piperazine-ethane sulphonic acid (HEPES), sodium ions, potassium ions, lactobionate, raffinose, glutathione, allopurinol, magnesium ions, trehalose, N-acetylcysteine, dibutyryl cAMP, nitroglycerin, or a combination thereof. In embodiments, an organ preservation solution is oxygenated. In embodiments, an organ preservation solution comprises 0.9% sodium chloride. an organ is stored in histidine-tryptophan ketoglutarate.

In embodiments, an organ is perfused with a perfusate prior to transplant. The term "perfuse" as it refers to an organ refers to the pumping of fluid (e.g., the perfusate) through the organ. In embodiments, the perfusate is delivered through the circulatory system or lymphatic system to an organ. In embodiments, the perfusate is delivered to the blood vessels of an organ. In embodiments, the perfusate is an organ preservation solution. In embodiments, the perfusate comprises plasma, whole blood, red blood cells, hemoglobin, human serum albumin, or a combination thereof. In embodiments, the perfusate comprises heparinized human whole blood. In embodiments, the perfusate is oxygenated.

In embodiments, the perfusate comprises antibody or an antibody fragment thereof that binds to glycoprotein 1B (GPIb). The antibody fragment thereof may be a variable heavy domain, a variable light domain, a constant light chain, a constant heavy chain domain (CH1, CH2, CH3, or CH4), or any combination thereof. In embodiments, the antibody fragment thereof is an antigen-binding fragment (Fab). In embodiments, the antibody or fragment thereof that binds to GPIb is a murine or human antibody. In embodiments, the perfusate comprises eptifibatide. In embodiments, the perfusate comprises eptifibatide and an antibody or an antibody fragment thereof that binds to glycoprotein 1B (GPIb).

In embodiments, an organ is perfused at a pressure between 30 mmHg and about 100 mmHg. For example, an organ is perfused at a pressure of about 30 mmHg, about 35 mmHg, about 40 mmHg, about 45 mmHg, about 50 mmHg, about 55 mmHg, about 60 mmHg, about 65 mmHg, about 70 mmHg, about 75 mmHg, about 80 mmHg, about 85 mmHg, about 90 mmHg, about 95 mmHg, or about 100 mmHg. In embodiments, an organ is perfused at a pressure from about 40 mmHg to about 75 mmHg.

In embodiments, an organ is perfused at a temperature between about 2° C. and about 37° C. For example, in embodiments, an organ is perfused at a temperature of about 2° C., about 3° C., about 4° C., about 5° C., about 6° C., about 7° C., about 8° C., about 9° C., about 10° C., about 11° C., about 12° C., about 13° C., about 14° C., about 15° C., about 16° C., about 17° C., about 18° C., about 19° C., about 20° C., about 21° C., about 22° C., about 23° C., about 24° C., about 25° C., about 26° C., about 27° C., about 28° C., about 29° C., about 30° C., about 31° C., about 32° C., about 33° C., about 34° C., about 35° C., about 36° C., or about 37° C. In embodiments, an organ is perfused at a temperature from about 20° C. to about 25° C.

In embodiments, an organ is perfused for about 5 minutes to about 2 days. For example, an organ is perfused for about 5 minutes, about 10 minutes, about 15 minutes, about 20 minutes, about 25 minutes, about 30 minutes, about 35 minutes, about 40 minutes, about 45 minutes, about 50 minutes, about 55 minutes, about 1 hour, about 1.25 hours, about 1.5 hours, about 1.75 hours, about 2 hours, about 2.25 hours, about 2.5 hours, about 2.75 hours, about 3 hours, about 3.25 hours, about 3.5 hours, about 3.75 hours, about 4 hours, about 4.25 hours, about 4.5 hours, about 4.75 hours, about 5 hours, about 5.25 hours, about 5.5 hours, about 5.75 hours, about 6 hours, about 7 hours, about 8 hours, about 9 hours, about 10 hours, about 11 hours, about 12 hours, about 13 hours, about 14 hours, about 15 hours, about 16 hours, about 17 hours, about 18 hours, about 19 hours, about 20 hours, about 21 hours, about 22 hours, about 23 hours, about 1 day, about 25 hours, about 26 hours, about 27 hours, about 28 hours, about 29 hours, about 30 hours, about 31 hours, about 32 hours, about 33 hours, about 34 hours, about 35 hours, about 36 hours, about 37 hours, about 38 hours, about 39 hours, about 40 hours, about 41 hours, about 42 hours, about 43 hours, about 44 hours, about 45 hours, about 46 hours, about 47 hours, or about 2 days.

In embodiments, an organ is perfused and subsequently stored at a temperature from about 4° C. to about 8° C.

In embodiments, a subject that receives a transplant of an organ that has been stored and/or perfused according to any one of the methods described herein exhibits a troponin I level that is decreased by between about 50% to about 100% as compared to a subject that receives a transplant of an organ that has not been stored and/or perfused according to one of the aforementioned methods. For example, the troponin I level of the subject that receives a transplant of an organ that has been stored and/or perfused according to any one of the methods described herein exhibits a troponin level that is about 50%, about 55%, about 60%, about 65%, about 70%, about 75%, about 80%, about 85%, about 90%, about 95%, about 97%, about 99%, or about 100% less than the troponin I level of a subject that receives a transplant of an organ that has not been stored and/or perfused according to one of the aforementioned methods.

In embodiments, a subject that receives a transplant of an organ that has been stored and/or perfused according to any one of the methods described herein does not exhibit thrombocytopenia. In embodiments, a subject that receives a transplant of an organ that has been stored and/or perfused according to any one of the methods described herein exhibits thrombocytopenia after a patient that receives a transplant of an organ that has not been stored and/or perfused according to one of the aforementioned methods. In embodiments, a subject that receives a transplant of an organ that has been stored and/or perfused according to any one of the methods described herein exhibits a 15% to about 500% higher platelet count than a subject that receives a transplant of an organ that has not been stored and/or perfused according to one of the aforementioned methods. For example, the subject that receives a transplant of an organ that has been stored and/or perfused according to any one of the methods described herein exhibits an about 15%, about 20%, about 25%, about 30%, about 35%, about 40%, about 45%, about 50%, about 55%, about 60%, about 65%, about 70%, about 75%, about 80%, about 85%, about 90%, about 95%, about 100%, about 110%, about 120% about 130%, about 140%, about 150%, about 160%, about 170%, about 180%, about 190% about 200%, about 210%, about 220%, about 230%, about 240%, about 250%, about 260%, about 270%, about 280%, about 290%, about 300%, about 3100%, about 320%, about 330%, about 340%, about 350%, about 360%, about 370%, about 380%, about 390%, about 400%, about 410%, about 420%, about 430%, about 440%, about 450%, about 460%, about 470%, about 480%, about 490% or about 500% higher platelet count than a subject that receives a transplant of an organ that has not been stored and/or perfused according to one of the aforementioned methods. Platelet count is measured according to any method known in the art. For example, platelet count is measured using a hemocytometer or flow cytometry.

In embodiments, prior to transplant, at substantially same time as transplant of an organ (e.g., within 1 hour of transplant), or after transplant of an organ, a subject is administered an induction therapy. The term "induction therapy" as it relates to organ transplant refers to any substance that reduces the risk of organ rejection. In embodiments, the induction therapy comprises anti-thymocyte globulin (ATG), rituximab, an anti-CD154 antibody or antibody fragment thereof, mycophenolate mofetil, rapamycin, tacrolimus, prednisone, or a combination thereof.

In embodiments, the xenotransplanted organ (e.g., heart, lung, liver, kidney, pancreas, spleen) exhibits sustained function once xenografted into a human or nonhuman primate for more than about 300 days, more than about 1 year, more than about 1.5 years, more than about 2 years, more than about 2.5 years, more than about 3 years, more than about 3.5 years, more than about 4 years, more than about 4.5 years, more than about 5 years, more than about 5.5 years, more than about 6 years, more than about 6.5 years, more than about 7 years, more than about 7.5 years, more than about 8 years, more than about 8.5 years, more than about 9 years, more than about 9.5 years, or more than about 10 years.

In embodiments, the disclosure provides for treating a subject having a disease, disorder or injury that results in a damaged, deficient or absent organ, tissue or cell function. In embodiments, the subject has suffered from an injury or trauma (e.g., an automobile accident) resulting in the damage of one or more cells, tissues or organs of the subject. In embodiments, the subject has suffered a fire or acid burn. In embodiments, the subject has a disease or disorder that results in a damaged, deficient or absent organ, tissue or cell function. In embodiments, the subject is suffering from an autoimmune disease. In embodiments, the subject is suffering from organ failure. In embodiments, the disease is selected from the group consisting of: heart disease (e.g., atherosclerosis), dilated cardiomyopathy, severe coronary artery disease, scarred heart tissue, birth defects of the heart, diabetes Type I or Type II, hepatitis, cystic fibrosis, cirrhosis, kidney failure, lupus, scleroderma, IgA nephropathy, polycystic kidney disease, myocardial infarction, emphysema, chronic bronchitis, bronchiolitis obliterans, pulmonary hypertension, congenital diaphragmatic hernia, congenital surfactant protein B deficiency, and congenital cystic emphysematous lung disease, primary biliary cholangitis, sclerosing cholangitis, biliary atresia, alcoholism, Wilson's disease, hemochromatosis, and/or alpha-1 antitrypsin deficiency.

In embodiments, any of the genetically modified cells, tissues and/or organs of the disclosure are separated from the genetically modified donor and administered into a non-donor subject host. "Administering" or "administration", as used in this context, includes, but is not limited to, introducing, applying, injecting, implanting, grafting, suturing, and transplanting. According to the disclosure, the genetically modified cells, tissues and/or organs may be administered by a method or route which results in localization of the organs, tissues, cells or compositions of the disclosure at a desired site. The organs, tissues, cells or compositions of the disclosure can be administered to a subject by any appropriate route which results in delivery of the cells to a desired location in the subject where at least a portion of the cells remain viable. In embodiments, at least 10%, 20%, 30%, 40%, 50%, 60%, 70%, 80%, 90%, or 100% of the cells (whether administered separately or as part of a tissue or organ) remain viable after administration to the subject. Methods of administering organs, tissues, cells or compositions of the disclosure are well-known in the art. In embodiments, the cells, tissues and/or organs are transplanted into the host. In embodiments, the cells, tissues and/or organs are injected into the host. In embodiments, the cells, tissues and/or organs are grafted onto a surface of the host (e.g., bone or skin).

In embodiments, a heart, lung, liver, kidney, pancreas, or spleen which has been genetically modified to harbor deletions or disruptions of GGTA1, CMAH, and B4GALNT2; expression of CD46, CD55, CD59, THBD, TFPI, PROCR, CD39, B2M, HLA-E, CD47, A20, PD-L1, HO1, CTLA-4 (e.g., LEA29Y), XIAP, and combinations thereof from a single multi-transgene cassette in the pig genome; along deletion of all PERV copies is transplanted into the host. In embodiments, a heart, lung, liver, kidney, pancreas, or spleen which has been genetically modified to harbor deletions of GGTA1, CMAH, and B4GALNT2; expression of one or more of CD46, CD55, CD59, THBD, TFPI, PROCR, CD39, B2M, HLA-E, CD47, A20, PD-L1, HO1, CTLA-4 (e.g., LEA29Y), XIAP, and combinations thereof from a single multi-transgene cassette in the pig genome; and functional inactivation of all PERV copies is transplanted into the host. In embodiments, the transplanted heart, lung, liver, kidney, pancreas, spleen, or a portion thereof survive and are functional for a period of time of about 1 day, about 1 week, about 2 weeks, about 3 weeks, about 1 month, about 2 months, about 3 months, about 4 months, about 5 months, about 6 months, about 9 months, about 1 year, about 2 years, about 3 years, about 4 years, about 5 years, about 6 years, about 7 years, about 8 years, about 9 years, about 10 years, or more.

In embodiments, it will be necessary to protect the genetically modified cell(s), tissue(s) or organ(s) from the immune system of the host to whom the genetically modified cell(s), tissue(s) or organ(s) are being administered. For example, in embodiments, the genetically modified cell(s), tissue(s) or organ(s) is administered with a matrix or coating (e.g., gelatin) to protect the genetically modified cell(s), tissue(s) or organ(s) from an immune response from the host. In embodiments, the matrix or coating is a biodegradable matrix or coating. In embodiments, the matrix or coating is natural. In other embodiments, the matrix or coating is synthetic.

In embodiments, the genetically modified cell(s), tissue(s) or organ(s) is administered with an immunosuppressive compound. In embodiments, the immunosuppressive compound is a small molecule, a peptide, an antibody, and/or a nucleic acid (e.g., an antisense or siRNA molecule). In embodiments, the immunosuppressive compound is a small molecule. In embodiments, the small molecule is a steroid, an mTOR inhibitor, a calcineurin inhibitor, an antiproliferative agent or an IMDH inhibitor. In embodiments, the small molecule is selected from the group consisting of corticosteroids (e.g., prednisone, budesonide, prednisolone), calcineurin inhibitors (e.g., cyclosporine, tacrolimus), mTOR inhibitors (e.g., sirolimus, everolimus), IMDH inhibitors (azathioprine, leflunomide, mycophenolate), antibiotics (e.g., dactinomycin, anthracyclines, mitomycin C, bleomycin, mithramycin) and methotrexate, or salts or derivatives thereof. In embodiments, the immunosuppressive compound is a polypeptide selected from the group consisting of: CTLA-4, anti-b7 antibody, abatacept, adalimumab, anakinra, certolizumab, etanercept, golimumab, infliximab, ixekizumab, natalizumab, rituximab, seckinumab, tocilizumab, ustekinumab, vedolizumab, basiliximab, daclizumab, and murmonab.

In embodiments, the genetically modified cell(s), tissue(s) or organ(s) to be administered to the subject have been further genetically modified such that they are less likely to induce an immune response in the subject. In embodiments, the genetically modified cell(s), tissue(s) or organ(s) have been further genetically modified such that they do not express functional immunostimulatory molecules.

VI. EXAMPLES

The following examples are provided to illustrate the disclosure and are merely for illustrative purpose only and should not be construed to limit the scope of the disclosure.

Example 1A: Graft Survival of Kidney Xenografts with Triple Xenoantigen Knockout and Multiple Human Transgenes in Cynomolgus Monkeys Purpose: The ability of inserted human transgenes (hTGs) to affect in vivo survival of kidney xenografts from pigs genetically modified to delete the three carbohydrate xenoantigens GGTA1, CMAH, and B4GALN2 (triple knock-out, TKO) was evaluated.

Methods: Seventeen cynomolgus monkeys received kidneys from four different TKO pig lines (TKO-A, TKO-B, TKO-F, and TKO-G) with various expression of hTGs, including immune regulatory genes (IMRGs; HLA-E, CD46, B2M and PDL1), complement regulatory genes (CPRGs; CD46, CD55 and CD59) and coagulation regulatory genes (CGRGs; THBD, TFPI and EPCR). The TKO-A pig line comprises Payload 10 of International Publication No. 2020/228810, which is incorporated by reference herein in its entirety. TKO-B comprises the Payload 9 of International Publication No. 2020/228810, which is incorporated by reference herein in its entirety. TKO-F comprises the polycistronic cassettes of FIG. 2D. TKO-G comprises the polycistronic cassettes of FIG. 4C. The recipients were treated with an induction therapy 2 days before transplant comprising anti-thymocyte globulin (ATG) and rituximab followed by weekly treatment with anti-CD154 antibody (20 mg/kg) and daily treatment with mycophenolate mofetil. Either rapamycin (rapa) or tacrolimus and prednisone (tac) were also administered for the first two months. FIG. 22 shows the timeline of the experiments.

Table 1 summarizes transgene expression of each TKO pig line. "N/A" designates TKO pig lines that do not contain a particular transgene, "–" indicates that a TKO pig line contains a particular transgene, but the transgene does not express; "+" indicates that a TKO pig line contains a particular transgene, and the transgene expresses.

TABLE 1

| | | | | | | |
|---|---|---|---|---|---|---|
| \multicolumn{7}{c}{Expression of Transgenes in Each TKO pig line} |
| Modification | Description of Gene | Gene | TKO-A (10) | TKO-B (9) | TKO-F (15S) | TKO-G (17P) |
| Inactivation | Xenoantigens | GGTA1 | KO | KO | KO | KO |
| | | CMAH | KO | KO | KO | KO |
| | | B4GALNT2 | KO | KO | KO | KO |
| Transgenes | Complement | CD46 | + | + | + | + |
| | Regulatory | CD55 | – | + | + | + |
| | Proteins | CD59 | – | + | N/A | N/A |
| | Cellular toxicity | HLA-E-B2M | + | + | N/A | + |
| | and innate immunity | CD47 | + | + | + | + |
| | Inflammation and | HO1 | + | – | + | N/A |
| | apoptosis | A20 | + | – | + | N/A |
| | | PDL-1 | + | – | N/A | N/A |
| | Coagulation | THBD | – | – | + | + |
| | | EPCR | N/A | N/A | + | N/A |
| | | TFPI | + | + | N/A | + |
| | | CD39 | – | – | N/A | N/A |

Table 2 summarizes the induction therapies that were administered to each monkey.

TABLE 2

| | | | |
|---|---|---|---|
| \multicolumn{4}{c}{Immunosuppressive regimens and xenograft survival in TKO plus hTGs recipients} |
| | \multicolumn{2}{c}{Immunosuppression} | |
| Donor | Maintenance | Tac/Rapa (1-2 months) | Survival Days for each animal |
| TKO-A (N = 2) | Anti-CD154 antibody (aCD154, also referred to as "aCD40L"), mycophenolate mofetil (MMF) | 1 none/1 rapa | 61, 2 |

TABLE 2-continued

Immunosuppressive regimens and xenograft
survival in TKO plus hTGs recipients

| | | Immunosuppression | |
| Donor | Maintenance | Tac/Rapa (1-2 months) | Survival Days for each animal |
| --- | --- | --- | --- |
| TKO-B (N = 6) | aCD154, MMF | 4 rapa 2 tac | 15, 20, 71, 265 135, 316 |
| TKO-F (N = 9) | aCD154, MMF | Tac | 8, 9, 45, 64, >78, >93, >156, >268, >275 |
| TKO-G (N = 2) | aCD154, MMF | Tac | >190, >173 |

Results. TKO-A expressed higher IMRCs with lower CPRCs, while TKO-B expressed high CPRGs with lower IMRGs. TKO-F had high expression of the CGRGs, THBD and FPCR, while TKO-G expressed moderate expression of the CGRGs, THBD and TFPI, and high expression of CPRGs (Table 1). In TKO-A group, the first recipient lost his xenograft on day 2 due to thrombotic microangiopathy (TMA), while the second recipient rejected on day 61 due to T cell mediated rejection and antibody mediated rejection (AMR). Among 6 recipients of TKO-B3, 2 monkeys lost their xenografts due to ureteral complication on day 15, and acute graft thrombosis on day 20. In the other four recipients, although one lost his graft on day 71 due to TMA, all other three recipients survived longer-term (135, 265 and 316 days) and only developed rejection after reduction of their immunosuppression due to infectious complications. In 7 TKO-F recipients, although 2 lost their xenografts early (day 8 and 9) and another on day 45 due to AMR/TMA, the remaining 4 recipients have been currently doing well as long as 190 days without any rejection or infectious complications. Finally, both TKO-G recipients have also been doing well for >90, >103 days (Table 2) with normal kidney function and without any evidence of rejection in their protocol biopsies.

FIG. 23 shows images of CD46, CD55, CD59, HLA-E, CD47, and PD-L1 expression in TKO-A and TKO-B xenografts compared to wild-type xenografts. FIG. 24 shows images of CD46, CD55, CD47, EPCR, THBD, A20, and HOT expression in TKO-C. FIG. 25 shows images of CD46, CD55, B2M, CD47, TFPI, and THBD expression in TKO-D. FIG. 26 shows the concentration of creatinine (labeled Cr) up to 313 days after transplant. FIG. 27 shows images of kidney tissue stained with either hematoxylin and eosin or complement component C4d.

FIGS. 29A-E are graphs showing blood urea nitrogen (BUN) and creatinine levels for five monkeys comprising TKO-F xenografts. The monkey of FIG. 29A has survived 320 days post organ transplant. The monkey of FIG. 29B has survived 313 days post organ transplant. The monkey of FIG. 29C has survived 201 days post organ transplant. The monkey of FIG. 29D has survived 121 days post organ transplant. The monkeys of FIGS. 29A-C were administered an immunosuppression regimen comprising 20 mg/kg aCD40L every 7 days. At day 254, the dosing frequency of aCD40L of the monkey of FIG. 29A was switched from dosing every 7 days to every 10 days. At day 240, the dosing frequency of aCD40L of the monkey of FIG. 29B was switched from dosing every 7 days to every 10 days. At day 128, the dosing frequency of aCD40L of the monkey of FIG. 29C was switched from dosing every 7 days to every 10 days. The monkey of FIG. 29E received a TKO-F xenograft that was also PERV-free. This data shows that BUN and creatinine levels of monkeys comprising TKO-F xenografts is stable for hundreds of days post-transplant.

FIGS. 30A-B are graphs showing blood urea nitrogen (BUN) and creatinine levels for two monkeys comprising TKO-G xenografts. Both animals were administered an immunosuppression regimen comprising 20 mg/kg aCD40L every 7 days until day 200. On day 200, the animals were administered aCD40L every 10 days.

FIGS. 38A-C show expression of the transgenes of TKO-F xenografts in tissue, glomeruli, and tubules.

This data shows that expression of human CGRGs provides for the long-term survival of porcine renal xenografts.

Example 1B: Graft Survival of Kidney Xenografts with Triple Xenoantigen Knockout and Multiple Human Transgenes in Cynomolgus Monkeys Purpose: The ability of inserted human transgenes (hTGs) to affect in vivo survival of kidney xenografts from pigs genetically modified to delete the three carbohydrate xenoantigens GGTA1, CMAH, and B4GALN2 (triple knock-out, TKO) was evaluated.

Methods: Cynomolgus monkeys received kidneys from a pig comprising the polycistronic cassettes of FIG. 2H or FIG. 2E. The polycistronic cassettes of FIG. 2H ("15S4") comprise a coagulation cassette comprising TFPI, THBD, and PROCR transgenes under the control of an ssUBC promoter, an innate immunity cassette comprising a B2M HLA-E fusion protein and CD47 under the control of an ssEEF1α1 promoter, and a complement regulation cassette comprising the CD46da and CD55 transgenes under the control of a CAG promoter. The polycistronic cassettes of FIG. 2E ("15S1") comprise a coagulation cassette comprising TFPI, THBD, and PROCR transgenes under the control of an ssUBC promoter, an innate immunity cassette comprising a B2M HLA-E fusion protein and CD47 under the control of a ssHSPA8 promoter, and a complement regulation cassette comprising the CD46da and CD55 transgenes under the control of a CAG promoter.

FIG. 39 shows expression of the transgenes of 15S4 in tissue, glomeruli, and tubules in the monkeys. FIG. 40 shows expression of the transgenes of 15S4 via immunohistochemistry. FIGS. 41A-D show that the transgenes of 15S1 and 15S4 both express. However, the innate immunity cassette of 1551 exhibits expression that is superior to 15S4.

Two out of three of the monkeys that received transplants comprising the 15S4 transgenes remained stable for at least 50 days after transplant. FIG. 31 and FIG. 32 are graphs showing blood urea nitrogen (BUN) and creatinine levels for these two monkeys. The transplant of the monkey of FIG. 31 was stable 68 days after transplant and is being monitored. The transplant of the monkey of FIG. 32 was stable 54 days after transplant and is being monitored.

Example 1C: Expression of Nucleic Acids Comprising the Polycistronic Cassettes of FIG. 2E in Fetal, Neonate, and Adult Tissue Purpose: The expression of a nucleic acid comprising the polycistronic cassettes of FIG. 2E ("15S1") was evaluated at various stages of a porcine's life cycle was evaluated. Table 3 shows expression of 15S1 transgenes in fetal, neonatal (1 day old), and adult (4 month old) porcine tissue.

TABLE 3

| | | Fetus 1 | Fetus 2 | Neonate 1 | Neonate 2 | Adult |
|---|---|---|---|---|---|---|
| | | Expression of 15S1 transgenes in fetal, neonatal, and adult porcine tissue | | | | |
| Transgene | Promoter | | | | | |
| TFPI | ssUBC | + | + | + | + | + |
| EPCR | ssUBC | + | + | + | + | + |
| THBD | ssUBC | + | + | + | + | + |
| B2M HLA-E Fusion protein | ssHSPA8 | + | + | + | + | + |
| CD47 | ssHSPA8 | + | + | + | + | + |
| CD46 | CAG | + | + | + | + | + |
| CD55 | CAG | + | + | + | + | + |

All transgenes were expressed in fetal, neonatal, and adult tissue. FIG. 42A shows expression of the 15S1 transgenes in porcine fetal kidneys relative to expression in wild-type Yucatan pigs. FIG. 42B shows expression of the 15S1 transgenes in porcine neonatal kidneys relative to expression in wild-type Yucatan pigs. FIG. 42C shows expression of the 15S1 transgenes in porcine adult kidneys relative to expression in wild-type Yucatan pigs. FIG. 43A shows expression of the 15S1 transgenes TFPI, EPCR, and THBD in porcine fetal, neonatal, and adult kidney tissues. FIG. 43B shows expression of the 15S1 transgenes B2M HLA-E fusion protein and CD47 in porcine fetal, neonatal, and adult kidney tissues. FIG. 43C shows expression of the 15S1 transgenes CD46 and CD55 in porcine fetal, neonatal, and adult kidney tissues. FIG. 43D shows expression of each of the 15S1 transgenes in two different fetal porcine kidney tissues.

Example 2: GPIb and GPIIb/IIIa Co-Inhibition Delays Consumptive Thrombocytopenia in Porcine Liver Xenografts Purpose: Porcine liver xenotransplant survival is compromised by thrombocytopenia that begins immediately upon xenograft reperfusion. Nonhuman primate recipients who survive porcine liver xenotransplantation recover their platelet count 7-10 days post transplantation. The effect of inhibition of platelet activation and adhesion via a GPIb and GPIIb/IIIa mechanism on the development of thrombocytopenia upon xenograft reperfusion was evaluated in an ex vivo machine perfusion model. The liver xenografts utilized in the study were from a wild-type pig or from a genetically engineered pig (referred to herein as "Pig 2.F") containing knockout of GGTA1, β4GalNT2, CMAH plus modifications targeting complement, inflammation, and coagulation regulation. Pig 2.F comprises the polycistronic cassettes of FIG. 2D.

Methods: Livers underwent normothermic machine perfusion using heparinized human whole blood and plasma perfusate. The perfusate was treated with the anti-GPIb fragmented murine antibody (ab) and the GPIIb/IIIa inhibitor eptifibatide prior to Pig 2.F liver cannulation (n=3). Pig 2.F perfusions without pharmacotherapy (n=3) were performed as controls. Perfusion was terminated when the vascular resistance prevented portal venous flow. Platelet count was measured throughout the perfusion by hematocytometer and within formalin-fixed samples by flow cytometry.

Results: The mean perfusion time was 12 hours for Pig 2.F livers perfused with ab and eptifibatide, and 10 hours for the livers untreated with ab and eptifibatide (ab/eptifibatide). There was no difference in combined artery and portal venous flow or lactate clearance between the Pig 2.F livers treated with ab/eptifibatide and livers that were not treated with ab/eptifibatide (FIG. 7A, FIG. 7B). However, treatment with ab/eptifibatide unexpectedly delays thrombocytopenia in the first 4 hours of perfusion, as measured by platelet count using a hemocytometer (FIG. 8A) and platelet count via flow cytometry (FIG. 8B).

Example 3: Development of an Ischemia Free Xenotransplantation Method for Transplanting a Genetically Porcine Xenograft to a Non-Human Primate Purpose: Ischemia reperfusion injury (IRI) is tissue damage that occurs when blood supply returns to a tissue after a period of ischemia or lack of oxygen. IRI can cause rejection of an organ transplant. A method to mitigate ischemia reperfusion injury was developed for transplant of a liver xenograft from a genetically modified pig to a non-human-primate model. The genetically modified pig comprises the polycistronic cassettes of FIG. 2D.

Methods: Two livers were procured for transplantation with an ischemia free technique. To establish arterial and portal inflow in-situ, the superior mesenteric artery and a portal vein graft were cannulated. With the liver fully mobilized, the suprahepatic inferior vena cava (IVC) was clamped, flow was initiated with an acellular hemoglobin-based oxygen carrying perfusate and the liver was excised and transferred on pump to the TransMedics machine (TransMedics, Andover, MA). FIG. 9A shows an image of the liver. Lactate clearance was monitored through ex-vivo normothermic perfusion. Two low anti-porcine triple knock out aortic endothelial cell titer baboons were selected as recipients and underwent standard hepatectomy with caval bypass. During implantation, the suprahepatic caval and portal anastomoses were completed while remaining on the pump, after which native perfusion was established. The baboons were recovered from anesthesia and returned to the cage for post-operative care. Blood was collected for laboratory analysis every four hours until euthanasia.

Results: During ex-vivo perfusion, the mean perfusate lactate fell from 3.5 to 0.3 (FIG. 9B). The baboons were anhepatic for an average of 52 minutes with average total implantation time (hepatectomy to bile duct completion) of 190 minutes. Both baboons required minimal phenylephrine support during the anhepatic phase and were subsequently weaned off upon establishing native circulation. Both were extubated at the conclusion of the case and returned to the cage, however required euthanasia after an average of 8.5 hours due to lactic acidosis, coagulopathy and multi-system organ failure. This study shows that an ischemia free xenotransplantation method is possible using a genetically modified xenograft.

Example 4: Effect of Cold Storage (CS) or Perfusion (IM) on the Function of a Cardiac Xenograft Purpose: The effect of storage temperature and perfusion on a genetically modified porcine heart xenograft's cardiac function was evaluated in an ex vivo model of initial cardiac xenograft dysfunction (ICXD). The genetically modified porcine hearts contained either (a) knockout of the three specific xenogenic carbohydrate genes (GGTA1, β4GalNT2, CMAH: referred to as "TKO" i.e., triple knock out) with variable expression of human complement- and thrombo-regulatory genes (n=13) or (b) GGTA1 knockout with knockin of CD55 (referred to as "GTKO.hCD55"). Cardiac function after cold storage (CS) or perfusion (IM) was also evaluated in wild-type porcine hearts (referred to as "WT").

Method: Hearts from genetically modified or wildtype (WT) pigs were procured after flushing with cold preservation solution (UW, 4° C.) and stored for 3 hours either in cold saline (0.9% w/w, 4° C.: cold storage (CS)) or were perfused with oxygenated Steen's solution with red blood cells (RBCs) (IM). IM perfusion at 40 mmHg was initiated at room temperature for 20 minutes to facilitate homogeneous graft perfusion before cooling to 4° C. for the remainder of the storage period. Heart function and laboratory parameters were assessed at specific timepoints on a working heart rig while perfused with freshly collected heparinized whole human blood. Troponin I was used as a marker for myocardial injury.

Results: In total, 19 hearts were perfused ex vivo, ten with CS (TKO n=6, GTKO.hCD55 n=1, WT n=3), and 9 with IM (TKO n=7, GTKO.hCD55 n=1, WT n=1). Mean troponin I elaboration (ng/mL) was significantly reduced after 1 hour of ex vivo perfusion in the TM group (70.2 ng/mL vs. 279.5 ng/mL; p=0.038), but not at final time points (FIGS. 10A-C). Similarly, the cardiac function (measured in cardiac output in response to increased filling pressures) in TKO hearts decreased over time after CS, whereas the IM-stored heart function improved over time (FIGS. 11A-D). IM significantly decreased myocardial injury during the first hour of ex vivo working heart perfusion relative to CS hearts: heart injury (troponin release) was attenuated, and graft failure was delayed in some TKO hearts treated with IM. These results show that IM attenuates ICXD of genetically modified pig hearts during initial exposure to human blood.

Example 5: Expression of a Nucleic Acid Comprising One or More Polycistronic Cassettes in a Porcine Donor Cell Porcine Fetal Cell, and Cell Isolated from an Adult Pig Purpose: Protein expression of porcine cells comprising the polycistronic cassettes of FIG. 2D in SCNT, porcine fetal cells, and cells isolated from an adult pig was evaluated. FIG. 13A shows expression of each cistron via flow cytometry. The cells that are circled comprise the polycistronic cassettes of FIG. 2D. FIG. 13B shows expression of each cistron by immunohistochemistry.

Example 6: Nucleic Acids Comprising the CD46 or CD55 Transgenes Protect Cells from Complement-Mediated Lysis Purpose: The ability of nucleic acids containing the transgenes CD46 and CD55 to protect cells from complement-mediated lysis by binding to complement proteins (e.g., complement component 3b (C3b) and complement component 4b (C4b)) was evaluated. Payload 15S (PL15S) pigs express the polycistronic cassettes of FIG. 2D.

Methods/Results: FIG. 14A-B show expression of CD55 (FIG. 14A) and CD46 (FIG. 14B) on the surface of cells. FIG. 15A shows surface protein expression of human CD46 and CD55 on ear punch derived cells (EPDCs) from PL15S pigs or from GGTA1 and B4GALNT2 double knock-out (DKO) pigs as a control, or isotype control-stained cells. FIG. 15B assesses complement activation in PL15S pigs or in DKO pigs. EPDCs from the same DKO or P15S pigs were incubated with 25% human serum deficient in complement component 6 (Serum (C6-)). C6 deficient serum is used to abrogate lysis of the cells by the membrane attack complex, the last step in complement activation, in order to assess by flow cytometry the deposition of complement component C3b, on the surface of the porcine cells due to C3 activation. In some conditions, cells were preincubated with saturating amounts of blocking antibodies to human CD46 (a-CD46) and/or human CD55 (a-CD55) to evaluate the individual contribution of those proteins to complement regulation. Heat-inactivated serum (HIS) was used in one condition to serve as a negative control as heat inactivates complement in serum. PL15S cells expressing human CD46 and CD55 proteins are protected from C3b deposition on the cell surface. When both human CD46 and CD55 are blocked, protection is lost and full C3b deposition is observed.

Example 7: Nucleic Acids Comprising the CD46 or CD55 Transgenes Protect Islet Cells from Complement-Mediated Lysis Purpose: The ability of nucleic acids containing the transgenes CD46 and CD55 to protect islet cells from complement-mediated lysis by binding to complement proteins (e.g., complement component 3b (C3b) and complement component 4b (C4b)) was evaluated. Islet cells were transfected with a nucleic acid containing the cassettes of FIG. 2D ("15S") or the nucleic acid containing the cassettes of FIG. 4D ("17S1") was evaluated.

FIG. 16A shows that in the absence of blocking antibodies (antibodies that bind to CD46 or CD55), cells expressing 15S reduce deposition of complement compared to cells that do not express 15S or cells that express CD46 and CD55 alone.

FIGS. 16B-16C shows that in the absence of blocking antibodies, cells expressing 17S reduce deposition of complement. In the presence of antibodies that block CD46, CD55, or both, complement deposition is not reduced.

This data collectively shows that CD46 and CD55 on the surface of islet cells is functional.

Example 8: Nucleic Acids Comprising the Transgenes CD46, CD55, or CD59 Reduce Deposition of Complement when the Transgenes are Linked Together by 2A Peptides Purpose: The effect of the presence of 2A peptides on the ability of CD46, CD55, and CD59 to reduce deposition of complement was evaluated.

Effect of introducing one 2A peptide on expression and function of CD46 and CD55: KCDC cells were transfected with a nucleic acid comprising CD46da, a nucleic acid comprising CD55, or a nucleic acid comprising CD46da and CD55 linked by a F2A peptide. FIG. 17A shows CD55 is expressed when linked to a 2A peptide. FIG. 17B shows CD46da (labeled "CD46") is expressed when linked to a 2A peptide. FIG. 17C shows that a nucleic acid comprising CD46da and CD55 reduces complement deposition.

Effect of Introducing two 2A peptides on expression and function of CD46, CD55, and CD59: KCDC cells were transfected with one of the following nucleic acids: (i) hsCD46da2; (ii) hsCD55; (iii) hsCD59; (iv) hsCD46da2-F2A-hsCD55; (v) hsCD46da2-F2A-hsCD59; (vi) hsCD55-P2A-hsCD59; or (viii) hsCD46da2-F2A-hsCD55-P2A-hsCD59. FIGS. 18A-C show that CD46 (FIG. 18A), CD55 (FIG. 18B), and CD59 (FIG. 18C) each express in these constructs. Each of these constructs also reduces complement deposition (FIG. 18D).

Example 9: Effect of CD46 Isoform Selection on Complement Deposition

Purpose: The ability of different CD46 isoforms to express and prevent complement protein deposition was evaluated.

Methods and Results: Robust surface expression of human CD46 on porcine cells derived from the kidney cortex transfected with the main isoforms of CD46 (SG-ABC1, SG-BC2, SG-BC1), on aortic derived endothelial cells from payload 15S pigs (PL15S AEC), and on human umbilical vein cells (HUVECs as a positive control) is shown in FIG. 19A. Untransfected kidney cortex-derived porcine cells (Empty) serves as a negative control. Surface C3b deposition on human CD46 isoform expressing cells, PL15S AECs, or untransfected cells (Empty) after incubation in 25% normal human serum is shown in the right graph. Cells expressing all isoforms of human CD46 are protected from C3b deposition whereas the untransfected cells not expressing CD46 exhibit high C3b deposition (FIG. 19B).

Example 10: Effect of Expression of Nucleic Acids Comprising CD46 and CD55 in Multiple Epithelial Cell (EC) Types Purpose: The expression and function of CD46 and CD55 in a nucleic acid containing the polycistronic cassettes of FIG. 2D ("15S") and a nucleic acid containing the polycistronic cassettes of FIG. 4C ("17P") was evaluated.

Methods and Results: Alveolar epithelial cells (AEC), kidney epithelial cells (KEC), porcine umbilicus vein endothelial cells (PUVEC), and human umbilical vein endothelial cells (HUVEC) were transfected with 15S or 17P. AEC, KEC, PUVEC, and HUVEC cells transfected with 15S (FIG. 20A) or 17P (FIG. 20B) expressed CD46 and CD55, whereas the TKO control cells which were not transfected with 15S or 17P did not. In the absence of antibodies that block CD46, CD55, or both, both 15S (FIG. 20C) and 17P (FIG. 20D) reduced complement deposition in AEC, KEC, and PUVEC cells.

Example 11: Nucleic Acids Comprising CD46 and CD55 Induce Protection from Organ Rejection The effect of expression of a nucleic acid containing the cassettes of FIG. 2D ("15S") in the presence of donor-specific alloantibodies (DSA) is evaluated.

Surface expression of human CD46 and CD55 proteins on aortic derived endothelial cells (AECs) from payload 15S (PL15S) pigs or from GGTA1, B4GALNT2, and CMAH triple knock-out pigs (TKO AECs) as a control, or isotype control-stained cells, is shown in FIG. 14. C3b deposition on TKO and PL15S AECs after incubation with 25% serum from a non-human primate recipient transplanted with a PL15S kidney (FIG. 21A) taken at multiple time points post-transplant. PL15S cells were protected from C3b deposition whereas TKO cells, lacking human CD46 and CD55 expression, exhibited significant C3b deposition over time, indicating human CD46 and CD55 on PL15S cells are protecting the cells from complement activation. Cells that do not express 15S have between 50% and 700% higher complement deposition.

The same TKO cells were also used to measure the development of anti-pig IgG or IgM antibodies post-transplant. TKO cells were incubated with the same serum samples from the non-human primate (right line graph) and bound immunoglobulin was measured by flow cytometry. IgG antibody develops over time whereas IgM antibody does not (FIG. 21B). Even in the presence of pig-reactive IgG antibodies, complement activation is controlled by human CD46 and CD55 proteins.

Example 12: Expression of a Nucleic Acid Comprising the Polycistronic Cassettes of FIG. 2E in Various Cell Types Purpose and Methods: The expression of a nucleic acid comprising the polycistronic cassettes of FIG. 2E was evaluated in various cell types. The nucleic acid of FIG. 2E comprises a coagulation cassette comprising TFPI, PROCR, and THBDda under the control of a ssUBC promoter; an innate immunity cassette comprising a B2M HLA-E fusion protein and CD47 under the control of a ssHSPA8 promoter; and a complement regulation cassette comprising CD46da and CD55 under the control of a CAG promoter.

Expression in fibroblasts. FIG. 33 shows that each transgene expressed in fibroblasts from a Yorkshire pig. FIG. 34 (see circled cells) shows that each transgene expressed in fibroblasts from a Yucatan pig.

Example 13: Expression of a Nucleic Acid Comprising the Polycistronic Cassettes of FIG. 2D in Various Cell Types Purpose and Methods: The expression of a nucleic acid comprising the polycistronic cassettes of FIG. 2D was evaluated in various cell types. The nucleic acid of FIG. 2D comprises a coagulation cassette comprising PROCR and THBD under the control of a ssUBC promoter; an inflammation and apoptosis cassette comprising A20 and HO1 under the control of a ssEF1α1 promoter; and a complement regulation and innate immunity cassette comprising CD46i, CD47, and CD55 under the control of a CAG promoter.

Expression in fibroblasts. FIG. 35 shows that each transgene expressed in fibroblasts from a Yorkshire pig.

Expression in fibroblasts containing a PERV knockout. FIG. 36 shows that each transgene expresses in fibroblasts containing a PERV knockout. The PERV free cells are circled in FIG. 36.

Example 14: Expression of a Nucleic Acid Comprising the Polycistronic Cassettes of FIG. 2H or FIG. 4A in Islet Cells Purpose and Methods: The expression of a nucleic acid comprising the polycistronic cassettes of FIG. 2H or FIG. 4A was evaluated in islet cells. The nucleic acid of FIG. 2H ("15S4") comprises a coagulation cassette comprising TFPI, PROCR, and THBDda under the control of a ssUBC promoter; an innate immunity cassette containing a B2M HLA-E fusion protein and CD47 under the control of a ssEF1α1 promoter; and a complement regulation cassette comprising CD46da and CD55 under the control of a CAG promoter. The nucleic acid of FIG. 4A ("17M1") comprises an innate immunity cassette containing a B2M HLA-E fusion protein and CD47 under the control of a ssUBC promoter; a coagulation cassette comprising TFPI*, CD39, and THBD under the control of a hsHSPA8 promoter; and a complement regulation and inflammation and apoptosis cassette comprising CD46da, CD55, CD59, A20, HO1, and PD-L1 under the control of a CAG promoter.

Evaluation of human A20 transgene protein: The activity of the human A20 transgene protein was also assessed in pigs comprising 17M1 (PL17M1). FIG. 37A is a Western blot analysis of islet cells from PL17M1 or wild type (WT) pigs probed with antibodies specific to human A20 or beta actin (B Actin), a housekeeping gene to serve as a cell lysate loading control. The Western blot indicates PL17M1 islet cells express human A20 protein. The porcine cells were treated with recombinant human TNFa to induce the activation of caspase 3 and caspase 7 (caspase 3/7) proteins involved in apoptosis. Caspase 3/7 activity was determined by luminescence following cleavage of a pro-luminescent probe that occurs in the presence of caspase proteins. A20 protects cells from TNFa mediated signals, including apoptosis induction by caspase proteins. PL17M1 cells expressing A20 protein show reduced luminescence indicating the cells are protected from TNFa mediated apoptosis (FIG. 37B).

FIG. 37A shows expression of A20 in islet cells comprising the polycistronic cassettes of FIG. 4A.

Islet cells expressing the polycistronic cassettes of 15S4 and 17M1 each express CD47. 15S4 islets express higher levels of CD47 than 17M1 islets (FIG. 44).

The ability of islet cells expressing 15S4 and 17M1 to protect against phagocytosis was evaluated. Briefly, islet cells labeled with a pH sensitive fluorescent dye were incubated in the presence of monocytes. As a negative control, islet cells were incubated without monocytes. During phagocytosis, the extracellular environmental pH of the phagosome becomes acidic. As a result, the amount of phagocytosis can be quantified by the acidity, represented by "total red area."

Both 15S4 islet cells and 17M1 cells protect from phagocytosis. However, dissociated 15S4 islet cells are superior at protecting from phagocytosis than 17M1 cells (FIG. 45).

Example 15: Expression of a Nucleic Acid Comprising a CpG Island Upstream of the Promoter Purpose and Methods: The effect of promoter selection on cistron expression was evaluated. The CD46 transgene or CD47 transgene was expressed in fibroblasts, beta islet cells, and a pulmonary arterial endothelial cell (pAEC)-SV40 cell line. Table 4 provides characteristics of the promoters used to express CD46. Table 5 provides characteristics of the promoters used to express CD47. Cistron expression was evaluated by flow cytometry.

TABLE 4

| Promoters used to express CD46 | | | |
|---|---|---|---|
| Promoter Name | SEQ ID NO: | Size of Promoter (kb) | CpG island |
| hsEF1α1 | 231 | 1.7 | yes |
| ssEF1α1 | 233 | 2 | yes |
| ssEF1α1 | 234 | 1.5 | yes |
| ssEF1α1 | 235 | 1 | no |

TABLE 5

| Promoters used to express CD47 | | | |
|---|---|---|---|
| Promoter Name | SEQ ID NO: | Size of Promoter (kb) | CpG island |
| CAG | 250 | 1.7 | yes |
| ssHSPA8 | 236 | 2.5 | yes |
| ssHSPA8 | 237 | 1.9 | yes |
| ssHSPA8 | 238 | 1.3 | no |

Results: Expression of CD46 and CD47 was stronger when controlled by promoters comprising a CpG island compared to standard promoters lacking a CpG island (FIGS. 48A-F)

Example 16: Islet Cell Function in Diabetic Mice Comprising Neonatal Porcine Islets (NPI) Comprising a Nucleic Acid Comprising the Polycistronic Cassettes of FIG. 4A Purpose Methods: Islet cell function in diabetic mice comprising NPI expressing a nucleic acid comprising the polycistronic cassettes of FIG. 4A was evaluated.

Results: FIG. 49 shows that insulin and glucagon were expressed in six of eight mice.

Example 17: Islet Cell Function in Diabetic NOD Scid Gamma (NSG) Mice Comprising Neonatal Porcine Islets (NPI) Comprising a Nucleic Acid Comprising the Polycistronic Cassettes of FIG. 4A Purpose Methods: Islet cell function in diabetic NSG mice comprising NPI expressing a nucleic acid comprising the polycistronic cassettes of FIG. 4A was evaluated. FIG. 50 shows a schematic of the experiment.

Results: FIG. 51 shows blood glucose levels in NSG mice. The results show that NPI protect mice from diabetes.

Example 18: Islet Cell Function in Cynomolgus Monkeys Comprising a Nucleic Acid Comprising the Polycistronic Cassettes of FIG. 4A Purpose Methods: Islet cell function in cynomolgus monkeys comprising neonatal porcine islets (NPI) expressing a nucleic acid comprising the polycistronic cassettes of FIG. 4A was evaluated.

Results: FIGS. 52A-B show fasting blood glucose concentrations, total insulin, and porcine C-peptide in two cynomologus monkeys. The monkey of FIG. 52B exhibits porcine C-peptide. Porcine C-peptide is a marker for insulin secretion. This data shows that the NPI are functional with respect to insulin production.

Example 19: Nucleic Acids Comprising the HLA-E Transgene Protect Cells from NK Cell Lysis Purpose: The ability of nucleic acids comprising a cistron encoding HLA-E (in the form of a cistron encoding a B2M HLA-E fusion protein) to protect cells from Natural Killer (NK) cell-mediated lysis was evaluated. The following nucleic acids were evaluated: (a) a nucleic acid expressing the polycistronic cassettes of FIG. 1D ("14P"), and (b) a nucleic acid expressing the polycistronic cassettes of FIG. 1C ("14S"). The 14P and 14S each comprise a gene encoding the B2M HLA-E fusion protein. Two variants of B2M HLA-E fusion protein were evaluated: (i) a B2M HLA-E fusion protein comprising the peptide epitope VMAPRTLIL (SEQ ID NO: 197) (labeled "Val" in FIG. 53B) and (ii) a B2M HLA-E fusion protein comprising the peptide epitope MAPRTLIL (SEQ ID NO: 251) (labeled "No Val" in FIGS. 53A-B).

Methods: The activity of the human HLA-E transgene is determined by co-culturing calcein labeled ear punch derived porcine cells (EPDCs) expressing a payload with human NK cells isolated from peripheral blood for several hours, then measuring calcein release by the cells due to NK mediated cell lysis using a plate reader.

Results: In FIG. 53A, representative surface protein expression from the human HLA-E transgene on porcine cells is shown. In FIG. 53B, the NK cell assay was performed to evaluate porcine cells expressing payloads 14P or 14S (PL14P or PL14S) with HLA-E transgene constructs containing sequences to encode the loading peptide with or without valine (PL14P/S Val or PL14P/S No Val, respectively). Wild type (WT) EPDCs not expressing the human HLA-E transgene or K562 cells, a human immortalized myelogenous leukemia cell line known to easily lysed by human NK cells, are included as positive controls for the assay. Porcine cells expressing human HLA-E transgene are protected from NK cell mediated lysis, and cells having the valine loading peptide are better protected.

Example 20: Nucleic Acids Express Functional
THBD and PROCR Transgenes

Purpose: The function of THBD and PROCR in a nucleic acid containing the polycistronic cassettes of FIG. 2D ("15S") was evaluated.

Methods and Results: Surface expression of human EPCR and THBD proteins on wild type (WT), GGTA1, B4GALNT2, and CMAH triple knock-out (TKO) aortic derived endothelial cells (AECs), human umbilical cord derived endothelial cells (Hu UVECs), and payload 15S porcine endothelial cells derived from the umbilical cord (Pig UVECs), aorta, or kidney (KECs) is shown in the left histogram graph (FIG. 54A). These cells were incubated with recombinant human protein C and the production of activated protein C was determined through a colorimetric change and read on a plate reader. Compared to wild type pig AECs lacking human EPCR and THBD, all porcine cells from PL15S pigs have functional EPCR and THBD proteins as evident by the presence activated protein C. (FIG. 54B).

Example 21: Nucleic Acids Expressing CD47
Protein Protect Against Phagocytosis

Surface expression of human CD47 protein on wild type (WT) and GGTA1 plus B4GALNT2 double knock-out (DKO) ear punch derived cells (EPDCs), and fetal fibroblasts (FF) derived from PL15S pigs (FIG. 57A). Phagocytosis was measured after co-culture of labeled pig cells with labeled primary human monocytes and assessing the amount of labeled pig cells engulfed by the monocytes by flow cytometry. A phagocytosis index, determined by the equation, total phagocytosed signal divided by the sum of the total phagocytosis signal plus the unphagocytosed signal, is used to assess reduction of phagocytosis of PL15S cells expressing CD47 transgene (FIG. 57B). The target index indicates the amount of PL15S cells present after the co-culture period is higher because the cells were protected from phagocytosis (FIG. 57C).

ABBREVIATIONS acute vascular rejection (AVR); activated partial thromboplastin time (APTT); adeno-associated virus integration site 1 (AAVS1); alanine aminotransferase (ALT); albumin (ALB); alpha 1,3-galactosyl-galactose (Gal or uGal); antibody-mediated rejection (AMR); anti-thymocyte globulin (ATG); asialoglycoprotein receptor 1 (ASGR1); aspartate aminotransferase (AST); β-1,4-N-acetylgalactosaminyl-transferase 2 (β4GalNT2); Beta-2 microglobulin (B2M); Cluster of Differentiation 39 (CD39); Cluster of Differentiation 47 (CD47); clustered regularly interspaced short palindromic repeats (CRISPR); class II transactivator dominant-negative (CIITA-DN); CMV early enhancer/chicken β actin (CAG); complement factor 3 (C3); complement factor 3 knockout (C3-KO); complete blood count (CBC); C—X—C motif chemokine receptor 3 (CXCR3); C—X—C motif chemokine receptor 12 (CXCR12); cytidine monophosphate-N-acetylneuraminic acid hydroxylase (CMAH); deoxyribonucleic acid (DNA); DQ Alpha (DQA); DR Alpha (DRA); droplet digital pCR (ddPCR); ecto-5' Nucleotidase (CD73); elongation factor 1α (EF1α); endothelial cells (EC); endothelial protein C receptor (EPCR); ex-vivo liver xenoperfusion (EVLXP); Fas ligand (FasL); fibrinogen levels (FIB); fluorescence-activated cell sorting (FACS); fresh frozen plasma (FFP); green fluorescent protein (GFP); glomerular filtration rate (GFR); glucagon like peptide 1 receptor (GLP-1R); glycoprotein IIb/IIIa (GpIIb/IIIa); glycoprotein α-1,3-galactosyltransferase 1 (GGTA1); GGTA knock out (GTKO); guide ribonucleic acid (gRNA); haemotoxylin and eosin (H+E); hepatic artery thrombosis (HAT); human embryonic kidney 293 (HEK293); heme oxygenase (HO1); homology-directed repair (HDR); human blood and plasma (hWB+P); human membrane cofactor protein (hCD46); human complement decay accelerating factor (hCD55); human complement regulatory proteins (hCRPs); human leukocyte antigen (HLA); human leukocyte antigen-E (HLA-E); human MAC-inhibitor factor (hCD59); immunoglobulin G (IgG); immunoglobulin G-degrading enzyme of *Streptococcus pyogenes* (IdeS); immunoglobulin M (IgM); immunohistochemistry (IHC); inosine monophosphate dehydrogenase (IMDH); interleukin 12 (IL12); interleukin 35 (IL35); international normalized ratio (INR); intracellular adhesion molecule-2 (ICAM2); killer inhibitory receptors (KIR); knockin (KI); knockout (KO); Kruppel associated box (KRAB); liver functional test (LFT); long terminal repeat (LTR); major histocompatibility complex class I (MHC class I); major histocompatibility complex class II (MHC class II); major histocompatibility complex, class I, E single chain trimer (HLA-ESCT); mechanistic target of rapamycin (mTOR); messenger ribonucleic acid (mRNA); modification of diet in renal disease (MDRD); mixed lymphocyte reaction (MLR); mycophenolate mofetil (MMF); natural killer (NK); N-glycolylneuraminic acid (Neu5Gc); neurogenic differentiation 1 (NeuroD); non-human primate (NHP); non-homologous end joining (NHEJ); orthotopic liver xenotransplants (OLTx); panel reactive antibody (PRA); peripheral blood mononuclear cell (PBMC); pig kidney-15 cells (PK15); porcine endogenous retroviruses (PERV); porcine endogenous retroviruses knockout (PERV KO); programmed death-ligand 1 (PD-L1); polymerase chain reaction (PCR); porcine aortic endothelial cell line (PEC-A or pAEC); potassium (K); Prothrombin Time (PT) and International Normalized Ratio (PT-NIR); quantitative reverse transcription polymerase chain reaction (qRT-PCR); recombinase-mediated cassette exchange (RMCE); red blood cell (RBC); ribonucleic acid sequencing (RNAseq); reverse transcriptase polymerase chain reaction (RT-PCT); sgRNA (single guide RNA); small interfering ribonucleic acid (siRNA); sodium (Na); somatic cell nuclear transfer (SCNT); superoxide dismutase 3 (SOD3); swine leukocyte antigen (SLA); T-cell mediated rejection (TCMR); thrombin-antithrombin III (TAT); thrombomodulin (THBD, TBM, or TM); thrombotic microangiopathy (TMA); tissue factor pathway inhibitor (TFPI); topoisomerase (TOPO); total bilirubin (Tbili); transcription activator-like (TAL) effector and nucleases (TALEN); tumor necrosis factor α-induced protein 3 (A20); tumor necrosis factor receptor 1 immunoglobulin (TNFR1-Ig); ubiquitous chromatin opening element (UCOE); von Willebrand factor (vWF); whole genome sequencing (WGS); wild type (WT); Zinc finger nucleases (ZFN).

INCORPORATION BY REFERENCE

All references, articles, publications, patents, patent publications, and patent applications cited herein are incorporated by reference in their entireties for all purposes. However, mention of any reference, article, publication, patent, patent publication, and patent application cited herein is not, and should not be taken as, an acknowledgment or any form of suggestion that they constitute valid prior art or form part of the common general knowledge in any country in the world.

SEQUENCE LISTING (266 sequences)

SEQ ID NO: 1 - DNA, 69 bp, synthetic construct
  misc_feature 1..69: note = E2A peptide
  source 1..69: mol_type = other DNA
ggaagcggacagtgtactaattatgctctcttgaaattggctggagatgttgagagcaaccctggacct

SEQ ID NO: 2 - DNA, 75 bp, synthetic construct
  misc_feature 1..75: note = F2A peptide
  source 1..75: mol_type = other DNA
ggaagcggagtgaaacagactttgaattttgaccttctcaagttggcgggagacgtggagtccaaccctggacct

SEQ ID NO: 3 - DNA, 66 bp, synthetic construct
  misc_feature 1..66: note = P2A peptide
  source 1..66: mol_type = other DNA
ggaagcggagctactaacttcagcctgctgaagcaggctggagacgtggaggagaaccctggacct

SEQ ID NO: 4 - DNA, 66 bp, synthetic construct
  misc_feature 1..66: note = P2A peptide
  source 1..66: mol_type = other DNA
ggcagcggcgccaccaatttctcactactgaaacaggccggtgacgtcgaggagaaccccgggcct

SEQ ID NO: 5 - DNA, 66 bp, synthetic construct
  misc_feature 1..66: note = P2A peptide
  source 1..66: mol_type = other DNA
ggcagtggagccaccaacttctcactccttaagcaggctggcgacgtggaggagaaccccgggcct

SEQ ID NO: 6 - DNA, 66 bp, synthetic construct
  misc_feature 1..66: note = P2A peptide
  source 1..66: mol_type = other DNA
ggcagtggcgccaccaattttagcctgttaaagcaggctggcgacgtggaggagaatcctgggcct

SEQ ID NO: 7 - DNA, 63 bp, synthetic construct
  misc_feature 1..63: note = T2A peptide
  source 1..63: mol_type = other DNA
aggtccaggattctcctcgacgtcaccgcatgttagcagacttcctctgccctctccgcttcc

SEQ ID NO: 8 - DNA, 63 bp, synthetic construct
  misc_feature 1..63: note = T2A peptide
  source 1..63: mol_type = other DNA
ggaagcggagagggcagaggaagtctgctaacatgcggtgacgtcgaggagaatcctggacct

SEQ ID NO: 9 - DNA, 69 bp, synthetic construct
  misc_feature 1..69: note = E2A peptide
  source 1..69: mol_type = other DNA
aggtccagggttgctctcaacatctccagccaatttcaagagagcataattagtacactgtccgcttcc

SEQ ID NO: 10 - DNA, 75 bp, synthetic construct
  misc_feature 1..75: note = F2A peptide
  source 1..75: mol_type = other DNA
aggtccagggttggactccacgtctcccgccaacttgagaaggtcaaaattcaaagtctgtttcactccgcttcc

SEQ ID NO: 11 - DNA, 575 bp, synthetic construct
  misc_feature 1..575: note = internal ribosome entry site (IRES)
  source 1..575: mol_type = other DNA
cccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgattatatggccacaacc

SEQ ID NO: 12 - DNA, 66 bp, synthetic construct
  misc_feature 1..66: note = P2A peptide
  source 1..66: mol_type = other DNA
aggcccaggattctcctccacgtcgccagcctgctttaacaggctaaaattggtggcgccactgcc

SEQ ID NO: 13 - DNA, 66 bp, synthetic construct
  misc_feature 1..66: note = P2A peptide
  source 1..66: mol_type = other DNA
aggcccggggttctcctccacgtcgccagcctgcttaaggagtgagaagttggtggctccactgcc

SEQ ID NO: 14 - DNA, 66 bp, synthetic construct
  misc_feature 1..66: note = P2A peptide
  source 1..66: mol_type = other DNA
aggtccagggttctcctccacgtctccagcctgcttcagcaggctgaagttagtagctccgcttcc

SEQ ID NO: 15 - DNA, 242 bp, synthetic construct
  misc_feature 1..242: note = 3 prime ITR
  source 1..242: mol_type = other DNA
taaaagttttgttactttatagaagaaattttgagtttttgtttttttttaataaataaataaacataaataaattgtttgttgaatttattattagtatgtaagtgtaaatataataaaacttaatatctattcaaattaataaataaacctcgatatacagaccgataaaacacatgcgtcaattttacgcatgattatctttaacgtacgtcacaatatgattatctttctagggttaa

SEQ ID NO: 16 - DNA, 242 bp, synthetic construct
  misc_feature 1..242: note = 3 prime ITR
  source 1..242: mol_type = other DNA
ttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaactttta

SEQ ID NO: 17 - DNA, 313 bp, synthetic construct
  misc_feature 1..313: note = 5 prime ITR
  source 1..313: mol_type = other DNA
gatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 18 - DNA, 313 bp, synthetic construct
  misc_feature 1..313: note = 5 prime ITR
  source 1..313: mol_type = other DNA
ttaaccctagaaagatagtctgcgtaaaattgacgcatgcattcttgaaatattgctctctctttctaaatagcgcgaatccgtcgctgtgcatttaggacatctcagtcgccgcttggagctcccgtgaggcgtgcttgtcaatgcggtaagtgtcactgattttgaactataacgaccgcgtgagtcaaaatgacgcatgattatcttttacgtgacttttaagatttaactcatacgataattatattgttatttcatgttctacttacgtgataacttattatatatatattttcttgttatagatatc

SEQ ID NO: 19 - DNA, 747 bp, Homo sapiens
  source 1..747: mol_type = genomic DNA
gcacacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcacccggcgctcacccgtcccagccccgccgcccgcagccccagctgcaacgcagccaccgccgccatcgcacccggccccgcgggcgcttccgggacgcaggaagcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaa

SEQ ID NO: 20 - DNA, 1554 bp, Homo sapiens
  source 1..1554: mol_type = genomic DNA
ccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctcccccacggaggcggctggccgacttccactgaggcgccaacggcctcgccatgcccttttcaataactcattgatttcaaacccgttacgtctatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggcc

SEQ ID NO: 21 - DNA, 673 bp, Homo sapiens
  source 1..673: mol_type = genomic DNA
gggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcc

SEQ ID NO: 22 - DNA, 995 bp, Homo sapiens
  source 1..995: mol_type = genomic DNA
gcacacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcaccccgcacccggcgctcacccgtcccagccccgccgcccgcagccccagctgcaacgcagccaccgccgccatcgcacccggccccgcgggcgcttccgggacgcaggaagcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaagggggcgcggcaggagggggcaccagggagcggagccctggccctcctgacgtcctgcccgcccacgcgtccgcaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgtaggtggtc

SEQ ID NO: 23 - DNA, 28537 bp, synthetic construct
  misc_feature 1..28537: note = 14M
  source 1..28537: mol_type = other DNA
ttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttaataacttcgtatagcatacattatacgaagttatcggggacagcccccccccaaagcccccagggatgtaattgcgtccctctcccgctagggggcagcagcgagccgcccggggctccgctccggcccgacgcttcccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccagcagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcctatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccaccatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgggaggcggaggatctggcggcggaggaagtggcggaggcggaagcggtggtggtggatctgggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagcgtttcagacaaaaagatgatgggaaatgccccttgaatcctcacagccacctaggaacatatggagtttttacaaacgctgcatttgacccgagtcctggcagtggcgccaccaattttagcctgttaaagcaggctggcgacgtggaggagaatcctgggcctatgcttggggtcctggtccttggcgcgctggccctggccggcctggggttccccgcacccgcagagccgcagccgggtggcagccaatgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactcggaagcggacagtgtactaattatgctctcttgaaattggctggagatgttgagagcaaccctggacctatggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagtaagctcgctttcttgctgtccaatttctattaaaggttcctttgttccccaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaagggggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagctttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattagggatgaaggctccaggctgctgccagaaatggagtcaccagcagaagaactgttttctctgataaggatgtcccaccattttcaagctgttcgttaaagttacacaggtccttcttgcagcagtagtacgttagctcattttccctcaagcgggttgtgacgtcgttgaaattgcaatgctcaaacttccaacacttgttatacacttgtaacccagctttggtaatgagacacgcatcaaaatcagatgaacaattgacggctgttttgcagtcagcagttgggttaggacagttgtagcactgcaggctatgacctgaatggcagaagacagccaggacgagcagcagcccgaacaggacagaccctccttggattcccataggcccggggttctcctccacgtcgccagcctgcttaaggagtgagaagttggtggctccactgccagtcagcaagcccatggttactagcgtcccaagcaaacctgtcaacgtgaaacacgtgtgcccagatagaagacgggtagtacctgaagtggttccacttcctttatttggggttgtttcatgaaaatgcttggttgtcctggaaacaggtgtactccgtgttgcttgagcatttggtgtggtggtttttgtggtggttttctgagaagttggtgagacttctgtagttggaacatttactgtggtaggtttctgaactgttggtgggaccttggaagttagagattttcctctgcattcaggtggtgggccactccactctccttcatcattattcacagtacaataaatagagtgctctccaatcatggtgaatcctttattacatgcatacgttacagactgtctatatccataatggtcacgttccccttgaattattccattgtcaatttgtggtggtgctggacaataaatttctctgcactctggcaacgggtcactccactggacagagctgcctgaaataagacaaaaactagaagtcgagccaaataatttgtaccctgtgttacatgagaaggagatggttgcaccaaataatatgccacctggtacatcaatctgaccatttcgtatttctcccggattagggcatgatttctttttacaaaattcgactgctgtggaccattttaaattctgaaggcaagttagttttggtgatagagaaggttctcttctgtaacctggacggcactcatattccacaacagtaccgactggaaaataattctgagtgatataaggctgtttgagggatgcagaatttagccttgttggcacctcgcagctacgattgcagaactcttcaatatctgaccattgactgcccttaaggcagatcactgagtccttctcgccaggaattttcacaaagctttcttcacatttgtacgttattacagtatcctcgggaaaacttgtacggccttccaaagctggctgggcattaggtacatctgggggaaggccacagtcaccccacacggccggcaggcacaacagcaccagcagcagcagccggggcagctccccgaggaggggcagcgccgcgggcacgctcggccgcgcgacggtcataggtccagggttggactccacgtctcccgccaacttgagaaggtcaaaattcaaagtctgtttcactccgcttccgagagaagtaaattttacttctctgtgggtctcatcagttaggtatgtgcctttcttcttcctcctttgaagatatctgtacgggacaacacaaattactgcaactccaacaactatggcaataacaatcacagcaatgacccaaacatccaaactgtcaagtattccttcctcaggtttaggatatcctggataatttgagactggaggcttgtaagtaggcctaggacctgaggcactggacgctggagattttgtagtggaagaagtcgacactgaatgactcaaagctggaggttttgtactagatggaggcagcactttaagacactttggaactgggggatcccaagtactgttactgtcacagacaattgtgtcgctgccatcgaggtaaaaacccttatcgcattcaaacataactgttgctttgtagtaaaatttttttccaaatcctgatatctgttttccattttcgactactggaaatcgacatttgaccactttacactctggagcagcacgactccacactgaattgtcaccacaataaatcgtgctctctccaataagtgaaaatggatctggtccaggtgcaggatcacaactataagttactgcatcaagatactcaaatacttctacttcactaaaggtgtgttttccattttttatttttggaggtggtgtacacaaaaccttttcacatattgggggcttaccgctccaaattgctactgatcctttaagttcacaatatagaatttcttcaccaattaagtaataaccctcattacaaataaagtgcatctgataaccaaactcgtaagtcccatttgcagggactgcttggccatttaaaggatcccgtatatatggacatgtttctctataacaggcgtcatctgagacaggtagccatgtatgattccgatcacaaatagtatgggtggcaagaggaggtatatagaagtatccttttttacacttataatctactcgttcaccaatctcatagtagggttttggtttaccaatgagctccatagcttcaaatgttggtggctcctcacaggcatcggagaaggagtacagcagcaacaccatggccgccagaagcaacccaggaaagcgccaggaaggaaagggacactcgcggcggccgggaggctccatggtggctcacgacacctgaaatggaagaaaaaaactttgaaccactgtctgaggcttgagaatgaaccaagatccaaactcaaaaagggcaaattccaaggagaattacatcaagtgccaagctggcctaacttcagtctccacccactcagtgtggggaaactccatcgcataaaacccctccccccaacctaaagacgacgtactccaaaagctcgagaactaatcgaggtgcctggacggcgcccggtactccgtggagtcacatgaagcgacggctgaggacggaaaggcccttttcctttgtgtgggtgactcacccgcccgctctcccgagcgccgcgtcctccattttgagctccctgcagcagggccgggaagcggccatctttccgctcacgcaactggtgccgaccgggccagccttgccgcccagggcggggcgatacacggcggcgcgaggccaggcaccagagcaggccggccagcttgagactacccccgtccgattctcggtggccgcgctcgcaggccccgcctcgccgaacatgtgcgctgggacgcacgggccccgtcgccgcccgcggccccaaaaaccgaaataccagtgtgcagatcttggcccgcatttacaagactatcttgccagaaaaaaagcgtcgcagcaggtcatcaaaaattttaaatggctagagacttatcgaaagcagcgagacaggcgcgaaggtgccaccagattcgcacgcggcggccccagcgcccaggccaggcctcaactcaagcacgaggcgaaggggctccttaagcgcaaggcctcgaactctcccacccacttccaacccgaagctcgggatcaagaatcacgtactgcagccaggtggaagtaattcaaggcacgcaagggccataacccgtaaagaggccaggcccgcgggaaccacacacggcacttacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagcctcaggcaccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctctcccacggaggcggctggccgacttccactgaggcgccaacggcctcgccatgcccttttcaataactcattgatttcaaacccgttacgtccatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggccagcgtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcggggggggggggggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgtctcgctccgtggccttagctgtgctcgcgctactctctctttctggcctcgaggctatggctccgcggactttaattttaggttgcggcgcttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataacccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgattatatggccacaaccatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggcggcagcggcgccaccaatttctcactactgaaacaggccggtgacgtcgaggagaaccccgggcctatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgggaagcggagagggcagaggaagtctgctaacatgcggtgacgtcgaggagaatcctggacctatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaaaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacagagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttgggggggggctgtccccgataacttcgtataggatactttatacgaagttatgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 24 - DNA, 20840 bp, synthetic construct
  misc_feature 1..20840: note = 14P
  source 1..20840: mol_type = other DNA
ttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttaataacttcgtatagcatacattatacgaagttatcggggacagcccccccccaaagcccccagggatgtaattgcgtccctctcccgctagggggcagcagcgagccgcccggggctccgctccggcccgacgcttcccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccagcagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcctatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccaccatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgggaggcggaggatctggcggcggaggaagtggcggaggcggaagcggtggtggtggatctgggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagcgtttcagacaaaaagatgatgggaaatgccccttgaatcctcacagccacctaggaacatatggagtttttacaaacgctgcatttgacccgagtcctatgcttggggtcctggtccttggcgcgctggccctggccggcctggggttccccgcacccgcagagccgcagccgggtggcagccaatgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctaagctcgctttcttgctgtccaatttctattaaaggttcctttgttccccaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaagggggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagctttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattagggatgaaggctccaggctgctgccagaaatggagtcaccagcagaagaactgttttctctgataaggatgtcccaccattttcaagctgttcgttaaagttacacaggtccttcttgcagcagtagtacgttagctcattttccctcaagcgggttgtgacgtcgttgaaattgcaatgctcaaacttccaacacttgttatacacttgtaacccagctttggtaatgagacacgcatcaaaatcagatgaacaattgacggctgttttgcagtcagcagttgggttaggacagttgtagcactgcaggctatgacctgaatggcagaagacagccaggacgagcagcagcccgaacaggacagaccctccttggattcccataggcccggggttctcctccacgtcgccagcctgcttaaggagtgagaagttggtggctccactgccgagagaagtaaattttacttctctgtgggtctcatcagttaggtatgtgcctttcttcttcctcctttgaagatatctgtacgggacaacacaaattactgcaactccaacaactatggcaataacaatcacagcaatgacccaaacatccaaactgtcaagtattccttcctcaggtttaggatatcctggataatttgagactggaggcttgtaagtaggcctaggacctgaggcactggacgctggagattttgtagtggaagaagtcgacactgaatgactcaaagctggaggttttgtactagatggaggcagcactttaagacactttggaactgggggatcccaagtactgttactgtcacagacaattgtgtcgctgccatcgaggtaaaaacccttatcgcattcaaacataactgttgctttgtagtaaaatttttttccaaatcctgatatctgttttccattttcgactactggaaatcgacatttgaccactttacactctggagcagcacgactccacactgaattgtcaccacaataaatcgtgctctctccaataagtgaaaatggatctggtccaggtgcaggatcacaactataagttactgcatcaagatactcaaatacttctacttcactaaaggtgtgttttccattttttatttttggaggtggtgtacacaaaaccttttcacatattgggggcttaccgctccaaattgctactgatcctttaagttcacaatatagaatttcttcaccaattaagtaataaccctcattacaaataaagtgcatctgataaccaaactcgtaagtcccatttgcagggactgcttggccatttaaaggatcccgtatatatggacatgtttctctataacaggcgtcatctgagacaggtagccatgtatgattccgatcacaaatagtatgggtggcaagaggaggtatatagaagtatccttttttacacttataatctactcgttcaccaatctcatagtagggttttggtttaccaatgagctccatagcttcaaatgttggtggctcctcacaggcatcggagaaggagtacagcagcaacaccatggccgccagaagcaacccaggaaagcgccaggaaggaaagggacactcgcggcggccgggaggctccatggtggctcacgacacctgaaatggaagaaaaaaactttgaaccactgtctgaggcttgagaatgaaccaagatccaaactcaaaaagggcaaattccaaggagaattacatcaagtgccaagctggcctaacttcagtctccacccactcagtgtggggaaactccatcgcataaaacccctccccccaacctaaagacgacgtactccaaaagctcgagaactaatcgaggtgcctggacggcgcccggtactccgtggagtcacatgaagcgacggctgaggacggaaaggcccttttcctttgtgtgggtgactcacccgcccgctctcccgagcgccgcgtcctccattttgagctccctgcagcagggccgggaagcggccatctttccgctcacgcaactggtgccgaccgggccagccttgccgcccagggcggggcgatacacggcggcgcgaggccaggcaccagagcaggccggccagcttgagactacccccgtccgattctcggtggccgcgctcgcaggccccgcctcgccgaacatgtgcgctgggacgcacgggccccgtcgccgcccgcggccccaaaaaccgaaataccagtgtgcagatcttggcccgcatttacaagactatcttgccagaaaaaaagcgtcgcagcaggtcatcaaaaattttaaatggctagagacttatcgaaagcagcgagacaggcgcgaaggtgccaccagattcgcacgcggcggccccagcgcccaggccaggcctcaactcaagcacgaggcgaaggggctccttaagcgcaaggcctcgaactctcccacccacttccaacccgaagctcgggatcaagaatcacgtactgcagccaggtggaagtaattcaaggcacgcaagggccataacccgtaaagaggccaggcccgcgggaaccacacacggcacttacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagcctcaggcaccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctctcccacggaggcggctggccgacttccactgaggcgccaacggcctcgccatgcccttttcaataactcattgatttcaaacccgttacgtccatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggccagcgtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcggggggggggggggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgtctcgctccgtggccttagctgtgctcgcgctactctctctttctggcctcgaggctatggctccgcggactttaattttaggttgcggcgcttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataaaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacagagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttgggggggggctgtccccgataacttcgtataggatactttatacgaagttatgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 25 - DNA, 20919 bp, synthetic construct
  misc_feature 1..20919: note = 14PV_LL
  source 1..20919: mol_type = other DNA
ttaaccctagaaagatagtctgcgtaaaattgacgcatgcattcttgaaatattgctctctctttctaaatagcgcgaatccgtcgctgtgcatttaggacatctcagtcgccgcttggagctcccgtgaggcgtgcttgtcaatgcggtaagtgtcactgattttgaactataacgaccgcgtgagtcaaaatgacgcatgattatcttttacgtgacttttaagatttaactcatacgataattatattgttatttcatgttctacttacgtgataacttattatatatatattttcttgttatagatatcataacttcgtataaagtatcctatacgaagttatcggggacagccccccccccaaagcccccagggatgtaattgcgtccctctcccgctagggggcagcagcgagccgcccggggctccgctccggcccgacgctccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccagcagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcctatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccaccatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgggaggcggaggatctggcggcggaggaagtggcggaggcggaagcggtggtggtggatctgggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagcgtttcagacaaaaagatgatgggaaatgccccttgaatcctcacagccacctaggaacatatggagtttttacaaacgctgcatttgacccgagtcctggcagtggcgccaccaattttagcctgttaaagcaggctggcgacgtggaggagaatcctgggcctatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctaagctcgctttcttgctgtccaatttctattaaaggttcctttgttccccaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaagggggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagctttttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattagggatgaaggctccaggctgctgccagaaatggagtcaccagcagaagaactgttttctctgataaggatgtcccaccattttcaagctgttcgttaaagttacacaggtccttcttgcagcagtagtacgttagctcattttccctcaagcgggttgtgacgtcgttgaaattgcaatgctcaaacttccaacacttgttatacacttgtaacccagctttggtaatgagacacgcatcaaaatcagatgaacaattgacggctgttttgcagtcagcagttgggttaggacagttgtagcactgcaggctatgacctgaatggcagaagacagccaggacgagcagcagcccgaacaggacagaccctccttggattcccataggtccagggttggactccacgtctcccgccaacttgagaaggtcaaaattcaaagtctgtttcactccgcttccgagagaagtaaattttacttctctgtgggtctcatcagttaggtatgtgcctttcttcttcctcctttgaagatatctgtacgggacaacacaaattactgcaactccaacaactatggcaataacaatcacagcaatgacccaaacatccaaactgtcaagtattccttcctcaggtttaggatatcctggataatttgagactggaggcttgtaagtaggcctaggacctgaggcactggacgctggagattttgtagtggaagaagtcgacactgaatgactcaaagctggaggttttgtactagatggaggcagcactttaagacactttggaactgggggatcccaagtactgttactgtcacagacaattgtgtcgctgccatcgaggtaaaaacccttatcgcattcaaacataactgttgctttgtagtaaaatttttttccaaatcctgatatctgttttccattttcgactactggaaatcgacatttgaccactttacactctggagcagcacgactccacactgaattgtcaccacaataaatcgtgctctctccaataagtgaaaatggatctggtccaggtgcaggatcacaactataagttactgcatcaagatactcaaatacttctacttcactaaaggtgtgttttccattcttgatctttggaggtggtgtacacaagaccttctcacatattgggggcttaccgctccaaattgctactgatcctttaagttcacaatacaggatctcctcaccaatcaggtagtaaccctcgttgcagatgaagtgcatctgataaccaaactcgtaagtcccatttgcagggactgcttggccatttaaaggatcccgtatatatggacatgtttctctataacaggcgtcatctgagacaggtagccatgtatgattccgatcacaaatagtatgggtggcaagaggaggtatatagaagtatccttttttacacttataatctactcgttcaccaatctcatagtagggttttggtttaccaatgagctccatagcttcaaatgttggtggctcctcacaggcatcggagaaggagtacagcagcaacaccatggccgccagaagcaacccaggaaagcgccaggaaggaaagggacactcgcggcggccgggaggctccatggtggctcacgacacctgaaatggaagaaaaaaactttgaaccactgtctgaggcttgagaatgaaccaagatccaaactcaaaaagggcaaattccaaggagaattacatcaagtgccaagctggcctaacttcagtctccacccactcagtgtggggaaactccatcgcataaaacccctccccccaacctaaagacgacgtactccaaaagctcgagaactaatcgaggtgcctggacggcgcccggtactccgtggagtcacatgaagcgacggctgaggacggaaaggcccttttcctttgtgtgggtgactcacccgcccgctctcccgagcgccgcgtcctccattttgagctccctgcagcagggccgggaagcggccatctttccgctcacgcaactggtgccgaccgggccagccttgccgcccagggcggggcgatacacggcggcgcgaggccaggcaccagagcaggccggccagcttgagactacccccgtccgattctcggtggccgcgctcgcaggccccgcctcgccgaacatgtgcgctgggacgcacgggccccgtcgccgcccgcggccccaaaaaccgaaataccagtgtgcagatcttggcccgcatttacaagactatcttgccagaaaaaaagcgtcgcagcaggtcatcaaaaattttaaatggctagagacttatcgaaagcagcgagacaggcgcgaaggtgccaccagattcgcacgcggcggccccagcgcccaggccaggcctcaactcaagcacgaggcgaaggggctccttaagcgcaaggcctcgaactctcccacccacttccaacccgaagctcgggatcaagaatcacgtactgcagccaggtggaagtaattcaaggcacgcaagggccataacccgtaaagaggccaggcccgcgggaaccacacacggcacttacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagcctcaggcaccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctcccccacggaggcggctggccgacttccactgaggcgccaacggcctcgccatgcccttttcaataactcattgatttcaaacccgttacgtccatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggccagcgtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatcccccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgtctcgctccgtggccttagctgtgctcgcgctactctctctttctggcctcgaggctgttatggctccgcggactttaattttaggttgcggcgcttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataaaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacagagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaatgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcgggggaagcgtcgggccggagcggagccccgggcggctcgctgctgccccctagcgggagagggacgcaattacatccctgggggctttgggggggggctgtccccgataacttcgtataatgtatgctatacgaagttattaaaagttttgttactttatagaagaaattttgagtttttgtttttttttaataaataaataaacataaataaattgtttgttgaatttattattagtatgtaagtgtaaatataataaaacttaatatctattcaaattaataaataaacctcgatatacagaccgataaaacacatgcgtcaattttacgcatgattatctttaacgtacgtcacaatatgattatctttctagggttaa

SEQ ID NO: 26 - DNA, 24793 bp, synthetic construct
  misc_feature 1..24793: note = 14S
  source 1..24793: mol_type = other DNA
ttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttaataacttcgtatagcatacattatacgaagttatcggggacagcccccccccaaagcccccagggatgtaattgcgtccctctcccgctagggggcagcagcgagccgcccggggctccgctccggcccgacgcttcccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccagcagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcctatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccaccatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgggaggcggaggatctggcggcggaggaagtggcggaggcggaagcggtggtggtggatctgggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagcgtttcagacaaaaagatgatgggaaatgccccttgaatcctcacagccacctaggaacatatggagtttttacaaacgctgcatttgacccgagtcctggcagtggcgccaccaattttagcctgttaaagcaggctggcgacgtggaggagaatcctgggcctatgcttggggtcctggtccttggcgcgctggccctggccggcctggggttccccgcacccgcagagccgcagccgggtggcagccaatgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctaagctcgctttcttgctgtccaatttctattaaaggttcctttgttccccaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaagggggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagctttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattagggatgaaggctccaggctgctgccagaaatggagtcaccagcagaagaactgttttctctgataaggatgtcccaccattttcaagctgttcgttaaagttacacaggtccttcttgcagcagtagtacgttagctcattttccctcaagcgggttgtgacgtcgttgaaattgcaatgctcaaacttccaacacttgttatacacttgtaacccagctttggtaatgagacacgcatcaaaatcagatgaacaattgacggctgttttgcagtcagcagttgggttaggacagttgtagcactgcaggctatgacctgaatggcagaagacagccaggacgagcagcagcccgaacaggacagaccctccttggattcccataggtccagggttggactccacgtctcccgccaacttgagaaggtcaaaattcaaagtctgtttcactccgcttccgagagaagtaaattttacttctctgtgggtctcatcagttaggtatgtgcctttcttcttcctcctttgaagatatctgtacgggacaacacaaattactgcaactccaacaactatggcaataacaatcacagcaatgacccaaacatccaaactgtcaagtattccttcctcaggtttaggatatcctggataatttgagactggaggcttgtaagtaggcctaggacctgaggcactggacgctggagattttgtagtggaagaagtcgacactgaatgactcaaagctggaggttttgtactagatggaggcagcactttaagacactttggaactgggggatcccaagtactgttactgtcacagacaattgtgtcgctgccatcgaggtaaaaacccttatcgcattcaaacataactgttgctttgtagtaaaatttttttccaaatcctgatatctgttttccattttcgactactggaaatcgacatttgaccactttacactctggagcagcacgactccacactgaattgtcaccacaataaatcgtgctctctccaataagtgaaaatggatctggtccaggtgcaggatcacaactataagttactgcatcaagatactcaaatacttctacttcactaaaggtgtgttttccattttttatttttggaggtggtgtacacaaaaccttttcacatattgggggcttaccgctccaaattgctactgatcctttaagttcacaatatagaatttcttcaccaattaagtaataaccctcattacaaataaagtgcatctgataaccaaactcgtaagtcccatttgcagggactgcttggccatttaaaggatcccgtatatatggacatgtttctctataacaggcgtcatctgagacaggtagccatgtatgattccgatcacaaatagtatgggtggcaagaggaggtatatagaagtatccttttttacacttataatctactcgttcaccaatctcatagtagggttttggtttaccaatgagctccatagcttcaaatgttggtggctcctcacaggcatcggagaaggagtacagcagcaacaccatggccgccagaagcaacccaggaaagcgccaggaaggaaagggacactcgcggcggccgggaggctccatggtggctcacgacacctgaaatggaagaaaaaaactttgaaccactgtctgaggcttgagaatgaaccaagatccaaactcaaaaagggcaaattccaaggagaattacatcaagtgccaagctggcctaacttcagtctccacccactcagtgtggggaaactccatcgcataaaacccctccccccaacctaaagacgacgtactccaaaagctcgagaactaatcgaggtgcctggacggcgcccggtactccgtggagtcacatgaagcgacggctgaggacggaaaggcccttttcctttgtgtgggtgactcacccgcccgctctcccgagcgccgcgtcctccattttgagctccctgcagcagggccgggaagcggccatctttccgctcacgcaactggtgccgaccgggccagccttgccgcccagggcggggcgatacacggcggcgcgaggccaggcaccagagcaggccggccagcttgagactacccccgtccgattctcggtggccgcgctcgcaggccccgcctcgccgaacatgtgcgctgggacgcacgggccccgtcgccgcccgcggccccaaaaaccgaaataccagtgtgcagatcttggcccgcatttacaagactatcttgccagaaaaaaagcgtcgcagcaggtcatcaaaaattttaaatggctagagacttatcgaaagcagcgagacaggcgcgaaggtgccaccagattcgcacgcggcggccccagcgcccaggccaggcctcaactcaagcacgaggcgaaggggctccttaagcgcaaggcctcgaactctcccacccacttccaacccgaagctcgggatcaagaatcacgtactgcagccaggtggaagtaattcaaggcacgcaagggccataacccgtaaagaggccaggcccgcgggaaccacacacggcacttacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagcctcaggcaccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctctcccacggaggcggctggccgacttccactgaggcgccaacggcctcgccatgcccttttcaataactcattgatttcaaacccgttacgtccatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggccagcgtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcggggggggggggggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgtctcgctccgtggccttagctgtgctcgcgctactctctctttctggcctcgaggctatggctccgcggactttaattttaggttgcggcgcttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataacccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgattatatggccacaaccatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggcggcagcggcgccaccaatttctcactactgaaacaggccggtgacgtcgaggagaaccccgggcctatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgtgaaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacagagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttgggggggggctgtccccgataacttcgtataggatactttatacgaagttatgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 27 - DNA, 28200 bp, synthetic construct
  misc_feature 1..28200: note = 15M1
  source 1..28200: mol_type = other DNA
ttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttaataacttcgtatagcatacattatacgaagttatcggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgaggcacacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcacccggcgctcacccgtcccagccccgccgcccgcagccccagctgcaacgcagccaccgccgccatcgcacccggccccgcgggcgcttccgggacgcaggaagcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaatgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccaccatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgggaggcggaggatctggcggcggaggaagtggcggaggcggaagcggtggtggtggatctgggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagcgtttcagacaaaaagatgatgggaaatgccccttgaatcctcacagccacctaggaacatatggagtttttacaaacgctgcatttgacccgagtcctggcagtggcgccaccaattttagcctgttaaagcaggctggcgacgtggaggagaatcctgggcctatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactcggaagcggacagtgtactaattatgctctcttgaaattggctggagatgttgagagcaaccctggacctatggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagtaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattagggatgaaggctccaggctgctgccagaaatggagtcaccagcagaagaactgttttctctgataaggatgtcccaccattttcaagctgttcgttaaagttacacaggtccttcttgcagcagtagtacgttagctcattttccctcaagcgggttgtgacgtcgttgaaattgcaatgctcaaacttccaacacttgttatacacttgtaacccagctttggtaatgagacacgcatcaaaatcagatgaacaattgacggctgttttgcagtcagcagttgggttaggacagttgtagcactgcaggctatgacctgaatggcagaagacagccaggacgagcagcagcccgaacaggacagaccctccttggattcccataggcccggggttctcctccacgtcgccagcctgcttaaggagtgagaagttggtggctccactgccagtcagcaagcccatggttactagcgtcccaagcaaacctgtcaacgtgaaacacgtgtgcccagatagaagacgggtagtacctgaagtggttccacttcctttatttggggttgtttcatgaaaatgcttggttgtcctggaaacaggtgtactccgtgttgcttgagcatttggtgtggtggtttttgtggtggttttctgagaagttggtgagacttctgtagttggaacatttactgtggtaggtttctgaactgttggtgggaccttggaagttagagattttcctctgcattcaggtggtgggccactccactctccttcatcattattcacagtacaataaatagagtgctctccaatcatggtgaatcctttattacatgcatacgttacagactgtctatatccataatggtcacgttccccttgaattattccattgtcaatttgtggtggtgctggacaataaatttctctgcactctggcaacgggtcactccactggacagagctgcctgaaataagacaaaaactagaagtcgagccaaataatttgtaccctgtgttacatgagaaggagatggttgcaccaaataatatgccacctggtacatcaatctgaccatttcgtatttctcccggattagggcatgatttctttttacaaaattcgactgctgtggaccattttaaattctgaaggcaagttagttttggtgatagagaaggttctcttctgtaacctggacggcactcatattccacaacagtaccgactggaaaataattctgagtgatataaggctgtttgagggatgcagaatttagccttgttggcacctcgcagctacgattgcagaactcttcaatatctgaccattgactgcccttaaggcagatcactgagtccttctcgccaggaattttcacaaagctttcttcacatttgtacgttattacagtatcctcgggaaaacttgtacggccttccaaagctggctgggcattaggtacatctgggggaaggccacagtcaccccacacggccggcaggcacaacagcaccagcagcagcagccggggcagctccccgaggaggggcagcgccgcgggcacgctcggccgcgcgacggtcataggtccagggttggactccacgtctcccgccaacttgagaaggtcaaaattcaaagtctgtttcactccgcttccgagagaagtaaattttacttctctgtgggtctcatcagttaggtatgtgcctttcttcttcctcctttgaagatatcggtacgggacaacacaaattactgcaactccaacaactatggcaataacaatcacagcaatgacccaaacatccaaactgtcaagtattccttcctcaggtttaggatatcctggataatttgagactggaggcttgtaagtaggcctaggacctgaggcactggacgctggagattttgtagtggaagaagtcgacactgaatgactcaaagctggaggttttgtactagatggaggcagcactttaagacactttggaactgggggatcccaagtactgttactgtcacagacaattgtgtcgctgccatcgaggtaaaaacccttatcgcattcaaacataactgttgctttgtagtaaaatttttttccaaatcctgatatctgttttccattttcgactactggaaatcgacatttgaccactttacactctggagcagcacgactccacactgaattgtcaccacaataaatcgtgctctctccaataagtgaaaatggatctggtccaggtgcaggatcacaactataagttactgcatcaagatactcaaatacttctacttcactaaaggtgtgttttccattcttgatctttggaggtggtgtacacaagaccttctcacatattgggggcttaccgctccaaattgctactgatcctttaagttcacaatacaggatctcctcaccaatcaggtagtaaccctcgttgcagatgaagtgcatctgataaccaaactcgtaagtcccatttgcagggactgcttggccatttaaaggatcccgtatatatggacatgtttctctataacaggcgtcatctgagacaggtagccatgtatgattccgatcacaaatagtatgggtggcaagaggaggtatatagaagtatccttttttacacttataatctactcgttcaccaatctcatagtagggttttggtttgccgatgagctccatagcttcaaatgttggtggctcctcacaggcatcggagaaggagtacagcagcaacaccatggccgccagaagcaacccaggaaagcgccaggaaggaaagggacactcgcggcggccgggaggctccatggtggcttagcttttagcgatggctttcacgacacctaagacgacaaaaaccttctttaaactactgtcccgacgaccggagactcaggcacaaccccaacagccaagggcaaactccagggagcattagcaccggcgccctgcgggccctgcccggcctacacccagcgaacggggccgccccggcgcccagcccctcccccacccgggccgcgagtcccgggaagcggcgcgggcagcaccgcccggccctttgtgcgccgcccgccgtccgcgtcctccatcttgagaccgggagcggccatctttccgcgctcgcagcccgcccgggcggggcgctgggtctccgaccgcccgccccgccccgccgcggccgtctgccccgggaccgccgggcacggaggccaccttgggcggcctcggctgggccgccctggcagtaacacgcggctgccggccgaactcgagcgcgaagacagacggggcgggcgcgaaggcgcggatcgcacgcggcggccacggcgccccagcaggccgccaccgggcacgcggtagggaaccgcgagagcggagggcctcgagttctccacctccccccgcccgcagctcggaatcaggaccagggcgcagagccctctacgcgcggggggccgggaggcacgctaaggccgtggccaccggcggaggccatgcggacggaggccacacccgtactcacctgtgtcctggcggcaaacccgttgcgaaaaagaacgttcgcggggaccacggcgcttatatatggtcctcccccaccctcggggaaaagggcggagccagcacacgacaccactttcccagtttaccccgcgccacctccacccggcaccggttccaccgccgtcccctccccccatcttcggggaccgtgggcgatgtgcgttcagcccactgacgagcacacggcgcccgggggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgtctcgctccgtggccttagctgtgctcgcgctactctctctttctggcctcgaggctgttatggctccgcggactttaattttaggttgcggcgcttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataacccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgattatatggccacaaccatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggcggcagcggcgccaccaatttctcactactgaaacaggccggtgacgtcgaggagaaccccgggcctatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgggaagcggagagggcagaggaagtctgctaacatgcggtgacgtcgaggagaatcctggacctatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaaaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacggagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccgataacttcgtataggatactttatacgaagttatgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 28 - DNA, 28552 bp, synthetic construct
  misc_feature 1..28552: note = 15M2
  source 1..28552: mol_type = other DNA
ttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttaataacttcgtatagcatacattatacgaagttatcggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgggaggcggaggatctggcggcggaggaagtggcggaggcggaagcggtggtggtggatctgggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagcgtttcagacaaaaagatgatgggaaatgccccttgaatcctcacagccacctaggaacatatggagtttttacaaacgctgcatttgacccgagtcctggcagtggcgccaccaattttagcctgttaaagcaggctggcgacgtggaggagaatcctgggcctatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactcggaagcggacagtgtactaattatgctctcttgaaattggctggagatgttgagagcaaccctggacctatggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagtaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattagggatgaaggctccaggctgctgccagaaatggagtcaccagcagaagaactgttttctctgataaggatgtcccaccattttcaagctgttcgttaaagttacacaggtccttcttgcagcagtagtacgttagctcattttccctcaagcgggttgtgacgtcgttgaaattgcaatgctcaaacttccaacacttgttatacacttgtaacccagctttggtaatgagacacgcatcaaaatcagatgaacaattgacggctgttttgcagtcagcagttgggttaggacagttgtagcactgcaggctatgacctgaatggcagaagacagccaggacgagcagcagcccgaacaggacagaccctccttggattcccataggcccggggttctcctccacgtcgccagcctgcttaaggagtgagaagttggtggctccactgccagtcagcaagcccatggttactagcgtcccaagcaaacctgtcaacgtgaaacacgtgtgcccagatagaagacgggtagtacctgaagtggttccacttcctttatttggggttgtttcatgaaaatgcttggttgtcctggaaacaggtgtactccgtgttgcttgagcatttggtgtggtggtttttgtggtggttttctgagaagttggtgagacttctgtagttggaacatttactgtggtaggtttctgaactgttggtgggaccttggaagttagagattttcctctgcattcaggtggtgggccactccactctccttcatcattattcacagtacaataaatagagtgctctccaatcatggtgaatcctttattacatgcatacgttacagactgtctatatccataatggtcacgttccccttgaattattccattgtcaatttgtggtggtgctggacaataaatttctctgcactctggcaacgggtcactccactggacagagctgcctgaaataagacaaaaactagaagtcgagccaaataatttgtaccctgtgttacatgagaaggagatggttgcaccaaataatatgccacctggtacatcaatctgaccatttcgtatttctcccggattagggcatgatttctttttacaaaattcgactgctgtggaccattttaaattctgaaggcaagttagttttggtgatagagaaggttctcttctgtaacctggacggcactcatattccacaacagtaccgactggaaaataattctgagtgatataaggctgtttgagggatgcagaatttagccttgttggcacctcgcagctacgattgcagaactcttcaatatctgaccattgactgcccttaaggcagatcactgagtccttctcgccaggaattttcacaaagctttcttcacatttgtacgttattacagtatcctcgggaaaacttgtacggccttccaaagctggctgggcattaggtacatctgggggaaggccacagtcaccccacacggccggcaggcacaacagcaccagcagcagcagccggggcagctccccgaggaggggcagcgccgcgggcacgctcggccgcgcgacggtcataggtccagggttggactccacgtctcccgccaacttgagaaggtcaaaattcaaagtctgtttcactccgcttccgagagaagtaaattttacttctctgtgggtctcatcagttaggtatgtgcctttcttcttcctcctttgaagatatcggtacgggacaacacaaattactgcaactccaacaactatggcaataacaatcacagcaatgacccaaacatccaaactgtcaagtattccttcctcaggtttaggatatcctggataatttgagactggaggcttgtaagtaggcctaggacctgaggcactggacgctggagattttgtagtggaagaagtcgacactgaatgactcaaagctggaggttttgtactagatggaggcagcactttaagacactttggaactgggggatcccaagtactgttactgtcacagacaattgtgtcgctgccatcgaggtaaaaacccttatcgcattcaaacataactgttgctttgtagtaaaatttttttccaaatcctgatatctgttttccattttcgactactggaaatcgacatttgaccactttacactctggagcagcacgactccacactgaattgtcaccacaataaatcgtgctctctccaataagtgaaaatggatctggtccaggtgcaggatcacaactataagttactgcatcaagatactcaaatacttctacttcactaaaggtgtgttttccattcttgatctttggaggtggtgtacacaagaccttctcacatattgggggcttaccgctccaaattgctactgatcctttaagttcacaatacaggatctcctcaccaatcaggtagtaaccctcgttgcagatgaagtgcatctgataaccaaactcgtaagtcccatttgcagggactgcttggccatttaaaggatcccgtatatatggacatgtttctctataacaggcgtcatctgagacaggtagccatgtatgattccgatcacaaatagtatgggtggcaagaggaggtatatagaagtatccttttttacacttataatctactcgttcaccaatctcatagtagggttttggtttgccgatgagctccatagcttcaaatgttggtggctcctcacaggcatcggagaaggagtacagcagcaacaccatggccgccagaagcaacccaggaaagcgccaggaaggaaagggacactcgcggcggccgggaggctccatggtggcttagcttttagcgatggctttcacgacacctaagacgacaaaaaccttctttaaactactgtcccgacgaccggagactcaggcacaaccccaacagccaagggcaaactccagggagcattagcaccggcgccctgcgggccctgcccggcctacacccagcgaacggggccgccccggcgcccagcccctcccccacccgggccgcgagtcccgggaagcggcgcgggcagcaccgcccggccctttgtgcgccgcccgccgtccgcgtcctccatcttgagaccgggagcggccatctttccgcgctcgcagcccgcccgggcggggcgctgggtctccgaccgcccgccccgccccgccgcggccgtctgccccgggaccgccgggcacggaggccaccttgggcggcctcggctgggccgccctggcagtaacacgcggctgccggccgaactcgagcgcgaagacagacggggcgggcgcgaaggcgcggatcgcacgcggcggccacggcgccccagcaggccgccaccgggcacgcggtagggaaccgcgagagcggagggcctcgagttctccacctccccccgcccgcagctcggaatcaggaccagggcgcagagccctctacgcgcggggggccgggaggcacgctaaggccgtggccaccggcggaggccatgcggacggaggccacacccgtactcacctgtgtcctggcggcaaacccgttgcgaaaaagaacgttcgcggggaccacggcgcttatatatggtcctcccccaccctcggggaaaagggcggagccagcacacgacaccactttcccagtttaccccgcgccacctccacccggcaccggttccaccgccgtcccctccccccatcttcggggaccgtgggcgatgtgcgttcagcccactgacgagcacacggcgcccgggggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgtctcgctccgtggccttagctgtgctcgcgctactctctctttctggcctcgaggctgttatggctccgcggactttaattttaggttgcggcgcttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataacccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgattatatggccacaaccatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggcggcagcggcgccaccaatttctcactactgaaacaggccggtgacgtcgaggagaaccccgggcctatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgggaagcggagagggcagaggaagtctgctaacatgcggtgacgtcgaggagaatcctggacctatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaaaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacggagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccgataacttcgtataggatactttatacgaagttatgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 29 - DNA, 21915 bp, synthetic construct
  misc_feature 1..21915: note = 15P
  source 1..21915: mol_type = other DNA
ttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttaataacttcgtatagcatacattatacgaagttatcggggacagcccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccagcagcccagactgcccagagccacatccagcctggccttgaatgcctgcagggatggggcatccacagcctccttgggcaacctgttcagtgcgtcaccaccctctggggggaaaacttcctcctcatatccaacctaaacctcccctgtctcagtttaaagccattccctcctgtcctatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgaggcacacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcaccccgcacccggcgctcacccgtcccagccccgccgcccgcagccccagctgcaacgcagccaccgccgccatcgcacccggccccgcgggcgcttccgggacgcaggaagcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaagggggcgcggcaggagggggcaccagggagcggagccctggccctcctgacgtcctgcccgcccacgcgtccgcaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgtaggtggtctgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccaccatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgggaggcggaggatctggcggcggaggaagtggcggaggcggaagcggtggtggtggatctgggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagcgtttcagacaaaaagatgatgggaaatgccccttgaatcctcacagccacctaggaacatatggagtttttacaaacgctgcatttgacccgagtcctggcagtggcgccaccaattttagcctgttaaagcaggctggcgacgtggaggagaatcctgggcctatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctaagctcgctttcttgctgtccaatttctattaaaggttcctttgttccccaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaagggggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagctttttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattagggatgaaggctccaggctgctgccagaaatggagtcaccagcagaagaactgttttctctgataaggatgtcccaccattttcaagctgttcgttaaagttacacaggtccttcttgcagcagtagtacgttagctcattttccctcaagcgggttgtgacgtcgttgaaattgcaatgctcaaacttccaacacttgttatacacttgtaacccagctttggtaatgagacacgcatcaaaatcagatgaacaattgacggctgttttgcagtcagcagttgggttaggacagttgtagcactgcaggctatgacctgaatggcagaagacagccaggacgagcagcagcccgaacaggacagaccctccttggattcccataggtccagggttggactccacgtctcccgccaacttgagaaggtcaaaattcaaagtctgtttcactccgcttccgagagaagtaaattttacttctctgtgggtctcatcagttaggtatgtgcctttcttcttcctcctttgaagatatctgtacgggacaacacaaattactgcaactccaacaactatggcaataacaatcacagcaatgacccaaacatccaaactgtcaagtattccttcctcaggtttaggatatcctggataatttgagactggaggcttgtaagtaggcctaggacctgaggcactggacgctggagattttgtagtggaagaagtcgacactgaatgactcaaagctggaggttttgtactagatggaggcagcactttaagacactttggaactgggggatcccaagtactgttactgtcacagacaattgtgtcgctgccatcgaggtaaaaacccttatcgcattcaaacataactgttgctttgtagtaaaatttttttccaaatcctgatatctgttttccattttcgactactggaaatcgacatttgaccactttacactctggagcagcacgactccacactgaattgtcaccacaataaatcgtgctctctccaataagtgaaaatggatctggtccaggtgcaggatcacaactataagttactgcatcaagatactcaaatacttctacttcactaaaggtgtgttttccattcttgatctttggaggtggtgtacacaagaccttctcacatattgggggcttaccgctccaaattgctactgatcctttaagttcacaatacaggatctcctcaccaatcaggtagtaaccctcgttgcagatgaagtgcatctgataaccaaactcgtaagtcccatttgcagggactgcttggccatttaaaggatcccgtatatatggacatgtttctctataacaggcgtcatctgagacaggtagccatgtatgattccgatcacaaatagtatgggtggcaagaggaggtatatagaagtatccttttttacacttataatctactcgttcaccaatctcatagtagggttttggtttaccaatgagctccatagcttcaaatgttggtggctcctcacaggcatcggagaaggagtacagcagcaacaccatggccgccagaagcaacccaggaaagcgccaggaaggaaagggacactcgcggcggccgggaggctccatggtggctcacgacacctgaaatggaagaaaaaaactttgaaccactgtctgaggcttgagaatgaaccaagatccaaactcaaaaagggcaaattccaaggagaattacatcaagtgccaagctggcctaacttcagtctccacccactcagtgtggggaaactccatcgcataaaacccctccccccaacctaaagacgacgtactccaaaagctcgagaactaatcgaggtgcctggacggcgcccggtactccgtggagtcacatgaagcgacggctgaggacggaaaggcccttttcctttgtgtgggtgactcacccgcccgctctcccgagcgccgcgtcctccattttgagctccctgcagcagggccgggaagcggccatctttccgctcacgcaactggtgccgaccgggccagccttgccgcccagggcggggcgatacacggcggcgcgaggccaggcaccagagcaggccggccagcttgagactacccccgtccgattctcggtggccgcgctcgcaggccccgcctcgccgaacatgtgcgctgggacgcacgggccccgtcgccgcccgcggccccaaaaaccgaaataccagtgtgcagatcttggcccgcatttacaagactatcttgccagaaaaaaagcgtcgcagcaggtcatcaaaaattttaaatggctagagacttatcgaaagcagcgagacaggcgcgaaggtgccaccagattcgcacgcggcggccccagcgcccaggccaggcctcaactcaagcacgaggcgaaggggctccttaagcgcaaggcctcgaactctcccacccacttccaacccgaagctcgggatcaagaatcacgtactgcagccaggtggaagtaattcaaggcacgcaagggccataacccgtaaagaggccaggcccgcgggaaccacacacggcacttacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagcctcaggcaccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctctcccacggaggcggctggccgacttccactgaggcgccaacggcctcgccatgcccttttcaataactcattgatttcaaacccgttacgtccatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggccagcgtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgtctcgctccgtggccttagctgtgctcgcgctactctctctttctggcctcgaggctgttatggctccgcggactttaattttaggttgcggcgcttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataaaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacagagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaatgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccgataacttcgtataggatactttatacgaagttatgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 30 - DNA, 22325 bp, synthetic construct
  misc_feature 1..22325: note = 15S
  source 1..22325: mol_type = other DNA
ttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttaataacttcgtatagcatacattatacgaagttatcggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgtggaagcggagctactaacttcagcctgctgaagcaggctggagacgtggaggagaaccctggacctatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactatcacatggcataaagccctacagcaactgtcgccaccagaaagctgagtgtaaggacccatcggagaagcggagcctgggagcgggtgttgagtgggggcttccctctgggagtctccacgggggcagaatcttgcactttgttgctggcccgctggcgaagccctggtgcccgtgaggggctctggtccttggtgtcatgggtcagcagctcctgcaactcctcaaagagctggatgttgagcaggaacgcagtcttggcctcttctatcaccctctgcctgactgcgggagtcatctccagggagttcatgcgggagcggtagagctgcttgaacttggtggcactggcaatgttggggaaggtgaagaaggccaggccctcgccagagctgggcaggtccagggctttctgggcaatctttttgagcacctggcccccagacaggtcacccaggtagcgggtgtaggcgtgggccaccagcagctcgggctctgtgcgccccacctcgtggagccgcttcacatagcgctgcatggctggtgtgtaggggatgacctcctgccagcggggcccgtaccagaaggccaggtcctgctccagggcagccttgcggtgcagctcttctgggaagtagacaggggcgaagactgggctctccttgttgcgctcaatctcctcctccagggccacatagatgtggtacagggaggccatcaccagcttgaagccgtctcgggtcacctggcccttctgaaagttcctcatgaactcagcattctctgcctgggtgtgcacctccttggtggcctccttcagggcctctgacaaatcctggggcatgctgtcgggttgcggacgctccataggtccagggttgctctcaacatctccagccaatttcaagagagcataattagtacactgtccgcttccgccatacatctgcttgaactgaaagcattcgttgcagtagccgttgcacttggcattgccaaaatgatcacaggcgggggcccggcaacgctgcttgggggggtcttcgggggcaggctcaccccggtgggccccagggcccatcctctggttgggatgctgacactccatgcagagctcctcgctgcggcaggccaggatgttcttgcaggaggcccgggcgcacttgggccttgaggtgctttgtgtggttcgaggcacatctctgcgctggctcgatctcagttgctcttctgtccttttggcctcatgaaatctctgattctgagcttcaatgaaacacttctggcagtatccttcaaacatggtgcttccaagggtgccgcattccctccccaggcacggaatggtgttctggaacctggacgctgtgggactgactttccctgaggcagcagcaaaatgtttgttttctctgtactcgatgaaacacagtgtgcaaaagcccttgttttctggagtcccaaaatacacgcagccggcttttctgcacttgctcgtccccgtcctgtccccaggagtccgtgcagcttgagacaggcagccagcaggggcgtcgtttccagctctgtggcaagaatgcggggaggggctccggacgagccgcgagggatctgacttggaacgctggtgacaggaaggagggaggctggtgctgaggctggaggaggcctctgctgtagtccttttgaagcaagtactgcagatcccattaaatgtcctggtaacatcctggaggcaggcttggcacttcccgggatccaagtgccttgtgtggtctggggcgtggctggcgtgaagttgccgggcgttgtggcaacgttcacaaaatccgttgtgctgcacattcagtgtgaaggggcagccggggctcctgcacttcatggcagtggtctcactgaacagaaaagggctgggtgctgtcggtggggccgaatgaggccccccagtggactcctcagggttccacgccaagggctcataggcttctccccgagaggccccgagcgccatgccagggagcccctcagggcccggcttggagttcagctttgggagtttgttttgattcttttgccgcctctctgagcactcatggcataaaggctgggtgttcacagacatgaagaaggggcagttgggcgtttcacattttacatccatgagagaaagctggggcacggaaggttccatgggattctgggcgtgcccctctctcctcccctgctcgctgttttcctgccatttcttgtactcatgctgaacaagttcaaagtaatcatctaccagattgatttcttttggtaagttagcttcatccaactttgcggcattgatgagatgagttgtgccatggtcccagccttggacggggatttctatcaccattaagtactcttttaagagcttctccttcatctcattttcaggatctgtcaaaaagtgaacttttaagtcttcaaatcttccccggtctctgttaacaagtggaacagctcggatttcaggcccactgtccttcagggtcaccaagggtacaaaatgatggctgtcatagccgagaacaatggggtatctgtagcattcctgggcaggccagtggagaggcaagtaaattccacccactttcaaaggggcgaaattggaacctgattccaaacttcttagcattttgtctgaaatgacaatgattggccttctgaggatgttgcaaaggacaaatatgtgtatttcttccagtgagttgtactgaagtccacttcgggccatgggtgtgtctgtggaagccattttgataagattgtcccattcatcattccagttccgagtatcatagcaaagccccgtttcaacaaattcctgagatttgagagactccagttgccagcggaatttaaagttgcgtgtgtctgtttccttgagcgtgctgaacagcgccttcctcagtaccaagtctgtgtcctgaacgccccacatgtactgagaagtggcatgcatgaggcaattgccgtcaccgttcgttttcagcgccacaagcttccggacttctcgacaccagttgagtttcttctggctttccagggtggcctggatgtttctgtcgatgagggctttgtggatgatctcccgaaactgaggacaaaactggcaagttctgaacatttccagtgtgtatcggtgcatggttttaaaatgatgaatgatcccattagtaggtttaaaaatgtcttctggagttctctcccgtatcttcacagctttccgcatattgctcaaatacaaagcctgaggaaggacttgttcagccatggtggcttagcttttagcgatggctttcacgacacctaagacgacaaaaaccttctttaaactactgtcccgacgaccggagactcaggcacaaccccaacagccaagggcaaactccagggagcattagcaccggcgccctgcgggccctgcccggcctacacccagcgaacggggccgccccggcgcccagcccctcccccacccgggccgcgagtcccgggaagcggcgcgggcagcaccgcccggccctttgtgcgccgcccgccgtccgcgtcctccatcttgagaccgggagcggccatctttccgcgctcgcagcccgcccgggcggggcgctgggtctccgaccgcccgccccgccccgccgcggccgtctgccccgggaccgccgggcacggaggccaccttgggcggcctcggctgggccgccctggcagtaacacgcggctgccggccgaactcgagcgcgaagacagacggggcgggcgcgaaggcgcggatcgcacgcggcggccacggcgccccagcaggccgccaccgggcacgcggtagggaaccgcgagagcggagggcctcgagttctccacctccccccgcccgcagctcggaatcaggaccagggcgcagagccctctacgcgcggggggccgggaggcacgctaaggccgtggccaccggcggaggccatgcggacggaggccacacccgtactcacctgtgtcctggcggcaaacccgttgcgaaaaagaacgttcgcggggaccacggcgcttatatatggtcctcccccaccctcggggaaaagggcggagccagcacacgacaccactttcccagtttaccccgcgccacctccacccggcaccggttccaccgccgtcccctccccccatcttcggggaccgtgggcgatgtgcgttcagcccactgacgagcacacggcgcccgggggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcacttcatctgcaacgagggttactacctgattggtgaggagatcctgtattgtgaacttaaaggatcagtagcaatttggagcggtaagcccccaatatgtgagaaggtcttgtgtacaccacctccaaagatcaagaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgactggaagcggagagggcagaggaagtctgctaacatgcggtgacgtcgaggagaatcctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataataaaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacggagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccgataacttcgtataggatactttatacgaagttatgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 31 - DNA, 25698 bp, synthetic construct
  misc_feature 1..25698: note = 15S1
  source 1..25698: mol_type = other DNA
ttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttaataacttcgtataaagtatcctatacgaagttatggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatcggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgggaggcggaggatctggcggcggaggaagtggcggaggcggaagcggtggtggtggatctgggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagcgtttcagacaaaaagatgatgggaaatgccccttgaatcctcacagccacctaggaacatatggagtttttacaaacgctgcatttgacccgagtcctggaagcggacagtgtactaattatgctctcttgaaattggctggagatgttgagagcaaccctggacctatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgtggaagcggagagggcagaggaagtctgctaacatgcggtgacgtcgaggagaatcctggacctatgcttggggtcctggtccttggcgcgctggccctggccggcctgggattccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcaactgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactatcagttattcctaggaggttgtatagtcttctgattggaagccacaaatttcatataaactagtccaagtaattgtgctagagctaagatactcaaacctgaaatcagaagagggccatgcattggtatacacgccgcaatacagagactcagtccaaccacagcgaggatataggctatcacctgaataaccaatatggcaatgacgaaggaggttaatccaatcgctgtactaaacacatagtagtgaagtaatattaatatccctgtagaagtcacaattaaaccaaggccagtagcattctttaatgaatattcacctgggacgaaaagaatggctccaacaatgacaatgacagtgatcactagtccagcaacaagtaaagcaattgttttctcatccataccaccggatctatatttaagtgttttaataccaaactgtccccagaacaggagtatagcaaaaattgggaaaataacaataagaatattttcatttggagaaaaccatgaaacaacacgatattttagctcgatgatcgtttcaccttctctggttaattctgttacttcacaagtgtagtttcctgtgtgtgagacagcatcactcttatccatcttcaaagaggcatctccttttagtaattgtgagacttcaatttttgcactactaaagtcagtggggacagtggacttgtttagagctccatcaaaggtgtaaatatctcttcctttaaatttccactttacgtatacttcagtagtgttttgtgcctccatattagtaacaaagcatggaatgacgacagtgtcattacaaaacgtgaattctacagattttgttttattaaatagtagctgagctgatccgcagcacgccgagcccagcaacagcgccgctaccaggggccacataggtccagggttctcctccacgtctccagcctgcttcagcaggctgaagttagtagctccgcttcccaagctgtgagactcagacccctgggcactgtcgctccactcagccttagagtagctccctccttttccacctgagctcttcttcctccatatcacagcagcaaccacagctccagagaccacagatccaaggagaaccaggccagcaatgatgcccacgatggggatggtgggctgggaagccggcttccatctcagggtgacgggctcgggtagcccctcatgctgcacatggcacgtgtatctctgctcctctccagaaggcaccaccacagctgcccacttctggaaggttccatcccctgcaggcctggtctccacgagctccgtgtcctgggtatggccctccccatcctgctgccaggtcagtgtgatctccgcagggtagaagcccagggcccagcacctcagggtggcctcatggtcagagatggggtggtgagtcacgtgtgtctttgggggctccaggtgaagcagcgtctccttccccttctccaggtatttgtggagccactccacgcatgtgtcttccaggtaggctctctggtgctccgcctcagaggcatcatttgacttttgctcggagatctgagccgccgtgtccaccgcggtccaggagcgcaggtcctcattcagggtgagataatccttgccgtcgtaggcgaactgttcatacccgcggaggaagcgcccgtcgggccccagctcgcagccatgcatccactgcagggtgtgagacccggcctcgctctgattgtagcagccgcgcagcgtccgcagattcactcggaaaatctgtgcggtgtccctggcgctccgtgtctcccggtcccaatactctgacccctcctgctccatccacggcgcccgcggcaccatcctcggactcgcggcgtcgttgtcgaagcgcacgaactgggtgtcgtccacgtagcccacagagatgaagcggggctccccgcggccgggccgggacacggaagtgtggaaatacttcaaggagtgagatccggaaccgccaccaccgcttcctccgccgccactaccgccaccaccagaaccgccaccacccatgtcgcgatcccacttaactatcttgggctgtgacaaagtcacatggttcacacggcaggcatactcatctttttcagtgggggtgaattcagtgtagtacaagagatagaaagaccagtccttgctgaaagacaagtctgaatgctccactttttcaattctctctccattcttcagtaagtcaacttcaatgtcggatggatgaaacccagacacatagcaattcaggaaatttgactttccattctctgctggatgacgtgagtaaacctgaatctttggcgtacgctggatggagccgccaccaccagaaccgccaccaccggaaccgccgcaacccaggaagagggttcggggcgccatgacagcctcgaggccagaaagagagagtagcgcgagcacagctaaggccacggagcgagacatggtggcggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatggggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagtaactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgactcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccgcggcatccctgcaagggatcctcacccccttttcttccttcattctctgctggtgtcaatcacagcttctagcagagggaaggcaggccaggcttggtttcttcttgcgagagtatttaactcagggccctgtagaacaatgagaatctgacctgcaactagctgggcgtgctggggcatgcctgtgtagtttcagctacttgggaggctgaggcaggagaattgcttgagcccaaagttgaggctgcagtgagccatggttgtgccattacactccagcctgggcaacacaagacccctgctcagaaataaaaagagaacctggcctgcagtgccaggcaggccctgaggtccaggagcctgggtatctccctctgcagcatgggtcacgaacaaactgggccctcagaggccacgggatggcgcccagtctccagtcacaaggcagaatccagacctcagcccatagctaaccagagctgtctgcaggccagatatggccccatggaccccctaccccaacttgactttgattccaggtccccctccgtctggatgaacaggtaggaattgcggcctctcctaagcctatgggagcctgggccaggctgaccctcaaggctgacagccacgatcccataggtgaaggcaaaggcgtggcagctaggaacacccactacacccccactcaagggaacaccgtgcccagctaccctgagacagccccactcccaggaaatgcaggtgccaaccagccccagtgaggcatggcacctgagccagacacccccaaatagtcccttcccacctcctcaagcatctgcactctgggtgaacccagaaaaactggggtacctggggagacatagaagggccaggccaggaactccccaataagcaggaacaggaacctgacccctgagcctcccccaccctctaaggctgctcaatgtcaaggcaggagggatctccacacacctgcactctgggtaaggacaagttggcccccactgccccacccttttgcagggttcaccctcctgcagggttcaccctctgctgcccccaacccagccacaccacaaagtcacacttggcctcaagagaaatgttctggcacctgcacttgcactggggacagcctattttgctagtttgttttgtttcgttttgttttgatggagagcgtatgttagtactatcgattcacacaaaaaaccaacacacagatgtaatgaaaataaagatattttattataacttcgtataatgtatgctatacgaagttatgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 32 - DNA, 24848 bp, synthetic construct
  misc_feature 1..24848: note = 15S2
  source 1..24848: mol_type = other DNA
ataacttcgtataaagtatcctatacgaagttatggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatcggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactatcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcataggtccaggattctcctcgacgtcaccgcatgttagcagacttcctctgccctctccgcttccacatcgccgtccacctgtgcacaggaagatgcctacagccacaccagcaatgatgaaactgcccaccaggacgcccaggaccagcgaagtgtaggagcggcttgtttggctccctttcgtgttttccgcggaaatatgtttctgcacatactgcacacaggtgtcctccaggaattcccgcagttcataccgagtgcggttgtaggcattgagctgctgcagggtgaaggtgaccactccggaggtgacctgggtgtctgcctgccacaaggctctctccggccggaaactcacaaaggagctcccattcacagccacttcgaagaagacatgggctctagagccctcgggaggcagctcacagcccaggaagcagcggatggtcagaggaaaggccaaggtccgctcctggtgcaccaggcgcacgaggccgtggaactggagcaggtaggactgcaggccactctgcgtgcgcgcccagctctcgggctcctgcaagggctgcagctgaatgatcgtggtgttggtgtctgggccttccagcacgtgcgttaggtgtccccccagcgacgcgttgccctggtaccacacgtgataggggtcgcggaagtaggagatctggagcatatgaagtctttggaggccatctgaggcgtcttggctacaaaaggcccagccagacagcagcagtatcggcagcaatgttgtcaacataggtccagggttgctctcaacatctccagccaatttcaagagagcataattagtacactgtccgcttccaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcggttgctgaaaaaaagaaaaatctggtttaaaaattcaattaatcaaaatatttccctcatcccttaacagaacacttaaccaggaaaaacgtatggccactgccaagaggtaatagtgcccatcacctcctgtctaagcacgcgcgaggtccagaactagtgctgcagtccaggttgccgtgccaaccgcagcagagcacgccctagatgaaggacccatctacccagacggcgtggggcgttgctcaacacgtggtcttaccccgaactgagcactgtctgttcccctccctcgccaggtgccagtgcccccgggagtcaacgggcttttaactactccggaatgtacccccatactggaagcacgccaagaacagctctgaagaaccacggtgggactggactaagcagggaactgggtgaaagaaaacgctggctccacttccccgcgcgccaggcaaaccgatgcagcaaccctcccccgccacgcggccgccgggcgtctcccagcctcccctggggccactgcggcccactccctacatttccgtcctgccggctgcaaccaaataccgctgccatcccaccgaaaactgaggccctttaagccggtagaaggagccgcacactcgcctcgacgagattctcagaacccccaagcctcagcaagcccaacaggcctgtgtggaggctgcacgctcccagacccacaacccaactcttgagcagaggttttacctggggtgtaggcctggctccaataacgaaggaagccacaaaaaacccaagagctgcaggcgagttcaatgagaccggtttccgcccgccaccctgcctcttataccctatcttagaaccttccagaaggggcccgcccctgctgcctgccattacggcttccccggccaatagacgcccggctgcccttacaagacccaatcacaagcccggctccactcctcgggcctcgcccccttccgcacccaccccaccgcgctccgcctcacgataacgcactcaccgcagcgttctggaactttcaagctcgcccccgctctccggacggccccggggaaagggagggtggggcgcagcgagtccgcgcgcgggagtcctcagttaccccgggcgggggaggggagcgtccacctctacgcatgcgcccccagcttccgcgggagggagggggcggaaaaaggaggaggaagaggggcgggcaaacttggaactaaccaatgatagcggcgctagccgggatcttggccggcacagaactgggggcggaatcgcgcggggcctgaagggaggggtttgggcgcgggagccgggccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctcccccacggaggcggctggccgacttccactgaggcgccaacggcctcgccatgcccttttcaataactcattgatttcaaacccgttacgtctatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagtagtaactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgactcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccgcggcatccctgcaagggatcctcacccccttttcttccttcattctctgctggtgtcaatcacagcttctagcagagggaaggcaggccaggcttggtttcttcttgcgagagtatttaactcagggccctgtagaacaatgagaatctgacctgcaactagctgggcgtgctggggcatgcctgtgtagtttcagctacttgggaggctgaggcaggagaattgcttgagcccaaagttgaggctgcagtgagccatggttgtgccattacactccagcctgggcaacacaagacccctgctcagaaataaaaagagaacctggcctgcagtgccaggcaggccctgaggtccaggagcctgggtatctccctctgcagcatgggtcacgaacaaactgggccctcagaggccacgggatggcgcccagtctccagtcacaaggcagaatccagacctcagcccatagctaaccagagctgtctgcaggccagatatggccccatggaccccctaccccaacttgactttgattccaggtccccctccgtctggatgaacaggtaggaattgcggcctctcctaagcctatgggagcctgggccaggctgaccctcaaggctgacagccacgatcccataggtgaaggcaaaggcgtggcagctaggaacacccactacacccccactcaagggaacaccgtgcccagctaccctgagacagccccactcccaggaaatgcaggtgccaaccagccccagtgaggcatggcacctgagccagacacccccaaatagtcccttcccacctcctcaagcatctgcactctgggtgaacccagaaaaactggggtacctggggagacatagaagggccaggccaggaactccccaataagcaggaacaggaacctgacccctgagcctcccccaccctctaaggctgctcaatgtcaaggcaggagggatctccacacacctgcactctgggtaaggacaagttggcccccactgccccacccttttgcagggttcaccctcctgcagggttcaccctctgctgcccccaacccagccacaccacaaagtcacacttggcctcaagagaaatgttctggcacctgcacttgcactggggacagcctattttgctagtttgttttgtttcgttttgttttgatggagagcgtatgttagtactatcgattcacacaaaaaaccaacacacagatgtaatgaaaataaagatattttattataacttcgtataatgtatgctatacgaagttat

SEQ ID NO: 33 - DNA, 23967 bp, synthetic construct
  misc_feature 1..23967: note = 15S3
  source 1..23967: mol_type = other DNA
ataacttcgtataaagtatcctatacgaagttatggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatcggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaacccggctcccgcgcccaaacccctcccttcaggccccgcgcgattccgcccccagttctgtgccggccaagatcccggctagcgccgctatcattggttagttccaagtttgcccgcccctcttcctcctcctttttccgccccctccctcccgcggaagctgggggcgcatgcgtagaggtggacgctcccctcccccgcccggggtaactgaggactcccgcgcgcggactcgctgcgccccaccctccctttccccggggccgtccggagagcgggggcgagcttgaaagttccagaacgctgcggtgagtgcgttatcgtgaggcggagcgcggtggggtgggtgcggaagggggcgaggcccgaggagtggagccgggcttgtgattgggtcttgtaagggcagccgggcgtctattggccggggaagccgtaatggcaggcagcaggggcgggccccttctggaaggttctaagatagggtataagaggcagggtggcgggcggaaaccggtctcattgaactcgcctgcagctcttgggttttttgtggcttccttcgttattggagccaggcctacaccccaggtaaaacctctgctcaagagttgggttgtgggtctgggagcgtgcagcctccacacaggcctgttgggcttgctgaggcttgggggttctgagaatctcgtcgaggcgagtgtgcggctccttctaccggcttaaagggcctcagttttcggtgggatggcagcggtatttggttgcagccggcaggacggaaatgtagggagtgggccgcagtggccccaggggaggctgggagacgcccggcggccgcgtggcgggggagggttgctgcatcggtttgcctggcgcgcggggaagtggagccagcgttttctttcacccagttccctgcttagtccagtcccaccgtggttcttcagagctgttcttggcgtgcttccagtatgggggtacattccggagtagttaaaagcccgttgactcccgggggcactggcacctggcgagggaggggaacagacagtgctcagttcggggtaagaccacgtgttgagcaacgccccacgccgtctgggtagatgggtccttcatctagggcgtgctctgctgcggttggcacggcaacctggactgcagcactagttctggacctcgcgcgtgcttagacaggaggtgatgggcactattacctcttggcagtggccatacgtttttcctggttaagtgttctgttaagggatgagggaaatattttgattaattgaatttttaaaccagatttttctttttttcagcaaccgccaccatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgggaggcggaggatctggcggcggaggaagtggcggaggcggaagcggtggtggtggatctgggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagcgtttcagacaaaaagatgatgggaaatgccccttgaatcctcacagccacctaggaacatatggagtttttacaaacgctgcatttgacccgagtcctggaagcggacagtgtactaattatgctctcttgaaattggctggagatgttgagagcaaccctggacctatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgtggaagcggagagggcagaggaagtctgctaacatgcggtgacgtcgaggagaatcctggacctatgcttggggtcctggtccttggcgcgctggccctggccggcctgggattccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcaactgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgatagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattcgttttgtgcagaaattttaaggtgactacacgcttagcccaactacccttgggaaatgtgtgtgtgttagtcactcaatcgtgtccagctctttgtgaccccatggactgtagcctgccaggctcctctgtccatgggattctccaggcaagaatactggagtgggttgccattccccaggggattttcccaacccaaggatcaaacccgagtttcctgcattgcaggcagattctttactctctgagccatcagggaagccctgtgggaaatgggaaccatgcaaaaacggctttgggaccaataagaccagaatatttgggatctgaactggcgcaagaaatgtggaagagagattctaaatgcatgtgtacatactaagttgcttcagtcatgtccgactatttgcaaccccatggaccacagcctgccaggctcctctgtccatgggattctccagtcaagaatactggagtgagtttccatttcctcttccaggggatcttccagacccagggatcaaaccagtgtctcttatgtctcctgtgttgacaggcaggttctttaccactagtgccacctgagacccaattctaaacgaggggttgcaaattcagtgccaacaggtgccaggtataagtggcaagggctgcatgtgaagggagaaatagcaaccagcccttaggctgcttgtgaaggatacagcacagaggggtgggaaccagggcagcctgaagtctcaggccccagctaaggatgtggcccagccagccttgttacattgcctgatcctgcattcaggactgcaggaggactttcctggtggtccagtggttgagaatccacatgccaatgcaggggacacgggttcaatccctgatctgggaagattccacatgcctcagggcaactacgcccgtacatcacaactaccgaagccctcgcacctagagcctgtgctctgcaacaggagaagccactcagggagaagcctgctcaccacaactagaaagtacagtagcccctgctcgctgcaactggagaaagccctcttgcagcaaccaacacccagcacagccaaaactaaatatatatatattttaaaagacctcaggggacttccctggtggttcagcgtgtaaggctctgtgtttccaatggagggggcccaggttcaacccctggttggagaactagatccctcatgctgaaattaaagatcccaagtgctgcaacctgactcagccaaaaaaaaaaaaaaaagctcagatgcagggctgccagaccttctgattctttgagacagacagggtatctagactttcatgtaaaatcaaatgtttacacattggcaactaattcatagtgaaaacattttaagggcaaaatttaacccaaacacatttgctcttcaagctgtcagtgagcaatttgttattagaggaatggattgggataacttgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagtagtaactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgactcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccgcggcatccctgcaagggatcctcacccccttttcttccttcattctctgctggtgtcaatcacagcttctagcagagggaaggcaggccaggcttggtttcttcttgcgagagtatttaactcagggccctgtagaacaatgagaatctgacctgcaactagctgggcgtgctggggcatgcctgtgtagtttcagctacttgggaggctgaggcaggagaattgcttgagcccaaagttgaggctgcagtgagccatggttgtgccattacactccagcctgggcaacacaagacccctgctcagaaataaaaagagaacctggcctgcagtgccaggcaggccctgaggtccaggagcctgggtatctccctctgcagcatgggtcacgaacaaactgggccctcagaggccacgggatggcgcccagtctccagtcacaaggcagaatccagacctcagcccatagctaaccagagctgtctgcaggccagatatggccccatggaccccctaccccaacttgactttgattccaggtccccctccgtctggatgaacaggtaggaattgcggcctctcctaagcctatgggagcctgggccaggctgaccctcaaggctgacagccacgatcccataggtgaaggcaaaggcgtggcagctaggaacacccactacacccccactcaagggaacaccgtgcccagctaccctgagacagccccactcccaggaaatgcaggtgccaaccagccccagtgaggcatggcacctgagccagacacccccaaatagtcccttcccacctcctcaagcatctgcactctgggtgaacccagaaaaactggggtacctggggagacatagaagggccaggccaggaactccccaataagcaggaacaggaacctgacccctgagcctcccccaccctctaaggctgctcaatgtcaaggcaggagggatctccacacacctgcactctgggtaaggacaagttggcccccactgccccacccttttgcagggttcaccctcctgcagggttcaccctctgctgcccccaacccagccacaccacaaagtcacacttggcctcaagagaaatgttctggcacctgcacttgcactggggacagcctattttgctagtttgttttgtttcgttttgttttgatggagagcgtatgttagtactatcgattcacacaaaaaaccaacacacagatgtaatgaaaataaagatattttattataacttcgtataatgtatgctatacgaagttat

SEQ ID NO: 34 - DNA, 25304 bp, synthetic construct
  misc_feature 1..25304: note = 15S4
  source 1..25304: mol_type = other DNA
ttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttaataacttcgtataaagtatcctatacgaagttatggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatcggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgggaggcggaggatctggcggcggaggaagtggcggaggcggaagcggtggtggtggatctgggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagcgtttcagacaaaaagatgatgggaaatgccccttgaatcctcacagccacctaggaacatatggagtttttacaaacgctgcatttgacccgagtcctggaagcggacagtgtactaattatgctctcttgaaattggctggagatgttgagagcaaccctggacctatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgtggaagcggagagggcagaggaagtctgctaacatgcggtgacgtcgaggagaatcctggacctatgcttggggtcctggtccttggcgcgctggccctggccggcctgggattccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcaactgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactatcagttattcctaggaggttgtatagtcttctgattggaagccacaaatttcatataaactagtccaagtaattgtgctagagctaagatactcaaacctgaaatcagaagagggccatgcattggtatacacgccgcaatacagagactcagtccaaccacagcgaggatataggctatcacctgaataaccaatatggcaatgacgaaggaggttaatccaatcgctgtactaaacacatagtagtgaagtaatattaatatccctgtagaagtcacaattaaaccaaggccagtagcattctttaatgaatattcacctgggacgaaaagaatggctccaacaatgacaatgacagtgatcactagtccagcaacaagtaaagcaattgttttctcatccataccaccggatctatatttaagtgttttaataccaaactgtccccagaacaggagtatagcaaaaattgggaaaataacaataagaatattttcatttggagaaaaccatgaaacaacacgatattttagctcgatgatcgtttcaccttctctggttaattctgttacttcacaagtgtagtttcctgtgtgtgagacagcatcactcttatccatcttcaaagaggcatctccttttagtaattgtgagacttcaatttttgcactactaaagtcagtggggacagtggacttgtttagagctccatcaaaggtgtaaatatctcttcctttaaatttccactttacgtatacttcagtagtgttttgtgcctccatattagtaacaaagcatggaatgacgacagtgtcattacaaaacgtgaattctacagattttgttttattaaatagtagctgagctgatccgcagcacgccgagcccagcaacagcgccgctaccaggggccacataggtccagggttctcctccacgtctccagcctgcttcagcaggctgaagttagtagctccgcttcccaagctgtgagactcagacccctgggcactgtcgctccactcagccttagagtagctccctccttttccacctgagctcttcttcctccatatcacagcagcaaccacagctccagagaccacagatccaaggagaaccaggccagcaatgatgcccacgatggggatggtgggctgggaagccggcttccatctcagggtgacgggctcgggtagcccctcatgctgcacatggcacgtgtatctctgctcctctccagaaggcaccaccacagctgcccacttctggaaggttccatcccctgcaggcctggtctccacgagctccgtgtcctgggtatggccctccccatcctgctgccaggtcagtgtgatctccgcagggtagaagcccagggcccagcacctcagggtggcctcatggtcagagatggggtggtgagtcacgtgtgtctttgggggctccaggtgaagcagcgtctccttccccttctccaggtatttgtggagccactccacgcatgtgtcttccaggtaggctctctggtgctccgcctcagaggcatcatttgacttttgctcggagatctgagccgccgtgtccaccgcggtccaggagcgcaggtcctcattcagggtgagataatccttgccgtcgtaggcgaactgttcatacccgcggaggaagcgcccgtcgggccccagctcgcagccatgcatccactgcagggtgtgagacccggcctcgctctgattgtagcagccgcgcagcgtccgcagattcactcggaaaatctgtgcggtgtccctggcgctccgtgtctcccggtcccaatactctgacccctcctgctccatccacggcgcccgcggcaccatcctcggactcgcggcgtcgttgtcgaagcgcacgaactgggtgtcgtccacgtagcccacagagatgaagcggggctccccgcggccgggccgggacacggaagtgtggaaatacttcaaggagtgagatccggaaccgccaccaccgcttcctccgccgccactaccgccaccaccagaaccgccaccacccatgtcgcgatcccacttaactatcttgggctgtgacaaagtcacatggttcacacggcaggcatactcatctttttcagtgggggtgaattcagtgtagtacaagagatagaaagaccagtccttgctgaaagacaagtctgaatgctccactttttcaattctctctccattcttcagtaagtcaacttcaatgtcggatggatgaaacccagacacatagcaattcaggaaatttgactttccattctctgctggatgacgtgagtaaacctgaatctttggcgtacgctggatggagccgccaccaccagaaccgccaccaccggaaccgccgcaacccaggaagagggttcggggcgccatgacagcctcgaggccagaaagagagagtagcgcgagcacagctaaggccacggagcgagacatggtggcttttgcttagcttttagcgatggctttcacgacacctaagacgacaaaaaccttctttaaactactgtcccgacgaccggagactcaggcacaaccccaacagccaagggcaaactccagggagcattagcaccggcgccctgcgggccctgcccggcctacacccagcgaacggggccgccccggcgcccagcccctcccccacccgggccgcgagtcccgggaagcggcgcgggcagcaccgcccggccctttgtgcgccgcccgccgtccgcgtcctccatcttgagaccgggagcggccatctttccgcgctcgcagcccgcccgggcggggcgctgggtctccgaccgcccgccccgccccgccgcggccgtctgccccgggaccgccgggcacggaggccaccttgggcggcctcggctgggccgccctggcagtaacacgcggctgccggccgaactcgagcgcgaagacagacggggcgggcgcgaaggcgcggatcgcacgcggcggccacggcgccccagcaggccgccaccgggcacgcggtagggaaccgcgagagcggagggcctcgagttctccacctccccccgcccgcagctcggaatcaggaccagggcgcagagccctctacgcgcggggggccgggaggcacgctaaggccgtggccaccggcggaggccatgcggacggaggccacacccgtactcacctgtgtcctggcggcaaacccgttgcgaaaaagaacgttcgcggggaccacggcgcttatatatggtcctcccccaccctcggggaaaagggcggagccagcacacgacaccactttcccagtttaccccgcgccacctccacccggcaccggttccaccgccgtcccctccccccatcttcggggaccgtgggcgatgtgcgttcagcccactgacgagcacacggcgcccggcgcatgctcctctcaaccaggaggatgacgactgctggtgggtgggaggcggggtcgagcgctcactcggttctaggtttagtgggagtttatcgacggtccctgggatttccctggctgaggagagtcctccttttgtatgaattactctccgcacagctggggggtggggcggcggggaggcgtccagaatcttccctgaaccggtcgtagcttaactgcaaagttggaccgagatgggagcccttacccggcagtaccccaccggtcctcagtcttgcggtctcgcaggttaaggactaacccctggagccgcttcctctgccggggcttctccaccgcccttgccgtccgcgccccttccggctggagagggaggcgtaaaaggccggggaaccgcggcggcaggggcctcggggcggtcttcagggccgagaatccgcgagtggctcagtttgctgaccaacagcctggcgaacaggctcctgcgctgacctcttggctttttccattcagttcttttatctaagttcgttctacacaccacgtggtactccagacgtccagtttttgagtttagaatagacttaagtactacagttttctttacttctaatcctaattttattacgtttaagaccctgagtgtgtgtctaccctcctattaacattttttttccagtgtatactcttggttgcaagcatgaaaaacctaaaaagaattttttgagttcagtgcttatacacgatctcaagtagagactaagatctacagcgccaggaagcttatccacccaatttactactccaacgtttgctgtgaaatcactgtttctcaaaaatggcctatcccatttgaataaacggcttcatcttttgtcgtcctatccattgtgactgcattttaggcataaatccagggcaagacaagatgaggcctttttggttggcaatcaggcagatattcaaaaatattcctgaagaaagaggaacctttattttaaatgagctaattactagatcgtctcttccacgtgtagagcactactgcaactttttgagccaatctatcaacaaatatttgagaacctactatgtggccagagctaagagtggctccgaagcatatgcaaaagaaatacttcctttgggggaagaaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagtaactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgactcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccgcggcatccctgcaagggatcctcacccccttttcttccttcattctctgctggtgtcaatcacagcttctagcagagggaaggcaggccaggcttggtttcttcttgcgagagtatttaactcagggccctgtagaacaatgagaatctgacctgcaactagctgggcgtgctggggcatgcctgtgtagtttcagctacttgggaggctgaggcaggagaattgcttgagcccaaagttgaggctgcagtgagccatggttgtgccattacactccagcctgggcaacacaagacccctgctcagaaataaaaagagaacctggcctgcagtgccaggcaggccctgaggtccaggagcctgggtatctccctctgcagcatgggtcacgaacaaactgggccctcagaggccacgggatggcgcccagtctccagtcacaaggcagaatccagacctcagcccatagctaaccagagctgtctgcaggccagatatggccccatggaccccctaccccaacttgactttgattccaggtccccctccgtctggatgaacaggtaggaattgcggcctctcctaagcctatgggagcctgggccaggctgaccctcaaggctgacagccacgatcccataggtgaaggcaaaggcgtggcagctaggaacacccactacacccccactcaagggaacaccgtgcccagctaccctgagacagccccactcccaggaaatgcaggtgccaaccagccccagtgaggcatggcacctgagccagacacccccaaatagtcccttcccacctcctcaagcatctgcactctgggtgaacccagaaaaactggggtacctggggagacatagaagggccaggccaggaactccccaataagcaggaacaggaacctgacccctgagcctcccccaccctctaaggctgctcaatgtcaaggcaggagggatctccacacacctgcactctgggtaaggacaagttggcccccactgccccacccttttgcagggttcaccctcctgcagggttcaccctctgctgcccccaacccagccacaccacaaagtcacacttggcctcaagagaaatgttctggcacctgcacttgcactggggacagcctattttgctagtttgttttgtttcgttttgttttgatggagagcgtatgttagtactatcgattcacacaaaaaaccaacacacagatgtaatgaaaataaagatattttattataacttcgtataatgtatgctatacgaagttatgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 35 - DNA, 29578 bp, synthetic construct
  misc_feature 1..29578: note = 16M
  source 1..29578: mol_type = other DNA
ttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttaataacttcgtatagcatacattatacgaagttatcggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgaggcacacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcaccccgcacccggcgctcacccgtcccagccccgccgcccgcagccccagctgcaacgcagccaccgccgccatcgcacccggccccgcgggcgcttccgggacgcaggaagcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaagggggcgcggcaggagggggcaccagggagcggagccctggccctcctgacgtcctgcccgcccacgcgtccgcaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgtaggtggtctgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccaccatgtctcgctccgtggccttagctgtgctcgcgctactctctctttctggcctcgaggctgttatggctccgcggactttaattttaggttgcggcgcttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattactataccatatctttccagaaatatgaaggcttgtgaaagataagcaagcctatgatggccactgtgaaaaggaccagggagaatagaaccatgaggaagacataggtggagtgggagagaggtgtggacaatggttgctcagctgggatcatgttggtcaggttcagcatgtagcccaaagtccagccggcgtcgctgccctggatcttgccaatgaaatggatgtgctcccaggaatcagctgtgaaatgatagccttgcagaaggagggagagaatgtaggtaccagaaaagcagtattcactcaggtacttctcctttactccagcgtaagatgtttttatctcctcccaaggctgagcacagaactttttcatcatctcagtcaccttttcctgagagactttctctgatgtcaagtttaaaaacttcatcacaaagtaaaaagctgaaaatgccccaaaatccccctggagtggtggcaagaaaatcccattgaaggcacactgggagtaagggcagtaactggtgttgaagagctccaggatgctttgatggcattgttgatagtttccaataccctggatttcaaactgctggaatggaagagtcatctcaaatctcttggtgcagggggtcttgtaaaggtcacttacgttcactaccttcttatatccaggatgaaagcatgggtccctgagaatttcattacttgcaacctgaatgtccttggccagtttctgccagagtgcctgatccttcccatagcacaagaagctatgtgtgtagacattgtagtccttgccatagaggcgaaattgcagagcattatctggggactcgatagtctggttttggggtacaaaagtgacttgtgtagaggctcccccaaggtccaaagctccaaaggtttcctgattattggtttcatatgggactatgctgaaccaccttgttttctgactgaatttgcccagcagatagttgatagtaatccagccataggcaccttcctcttggccagtaatgatcctggcaccctggaagtcaaaggggtagttgctgaggctcctctccaccacatccagaaccctgtctgccaactcttcactttccatcctgagcaaccgcatgcctgccgtggctcccaggtaaacgggtgtctcttggtgctgggaccttggaatcacttccctagctctttccatgcaatcagtcaggtaaatgcctatttcatttactttctgaacaaattttgagattccaggacctttaaccctgcattcttctacttgatgcaccacgcctgtgtcattctccttttctgctggccacttatagatgtataaacttgtgtgagaagaacccgcatccagcacaatcccatacttaacgttttctggcaatgctttgttctgggtcaaccccacagcaagcaaagctatcacagctatgatagaggagaagccaaggatggctaggatattcttggagcaaaatgtcttcacgttagactcctttgtatcttccataggtccagggttgctctcaacatctccagccaatttcaagagagcataattagtacactgtccgcttccgagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagctgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaaccccaggccggccagggccagcgcgccaaggaccaggaccccaagcataggcccaggattctcctccacgtcgccagcctgctttaacaggctaaaattggtggcgccactgccaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggctcacgacacctgaaatggaagaaaaaaactttgaaccactgtctgaggcttgagaatgaaccaagatccaaactcaaaaagggcaaattccaaggagaattacatcaagtgccaagctggcctaacttcagtctccacccactcagtgtggggaaactccatcgcataaaacccctccccccaacctaaagacgacgtactccaaaagctcgagaactaatcgaggtgcctggacggcgcccggtactccgtggagtcacatgaagcgacggctgaggacggaaaggcccttttcctttgtgtgggtgactcacccgcccgctctcccgagcgccgcgtcctccattttgagctccctgcagcagggccgggaagcggccatctttccgctcacgcaactggtgccgaccgggccagccttgccgcccagggcggggcgatacacggcggcgcgaggccaggcaccagagcaggccggccagcttgagactacccccgtccgattctcggtggccgcgctcgcaggccccgcctcgccgaacatgtgcgctgggacgcacgggccccgtcgccgcccgcggccccaaaaaccgaaataccagtgtgcagatcttggcccgcatttacaagactatcttgccagaaaaaaagcgtcgcagcaggtcatcaaaaattttaaatggctagagacttatcgaaagcagcgagacaggcgcgaaggtgccaccagattcgcacgcggcggccccagcgcccaagccaggcctcaactcaagcacgaggcgaaggggctccttaagcgcaaggcctcgaactctcccacccacttccaacccgaagctcgggatcaagaatcacgtactgcagccaggggcgtggaagtaattcaaggcacgcaagggccataacccgtaaagaggccaggcccgcgggaaccacacacggcacttacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagcctcaccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctcccccacggaggcggctggccgacttccactgaggcgccaacggcctcgccatgcccttttcaataactcattgatttcaaacccgttacgtctatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcacttcatctgcaacgagggttactacctgattggtgaggagatcctgtattgtgaacttaaaggatcagtagcaatttggagcggtaagcccccaatatgtgagaaggtcttgtgtacaccacctccaaagatcaagaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgactggcagtggagccaccaacttctcactccttaagcaggctggcgacgtggaggagaaccccgggcctatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctgataacccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgattatatggccacaaccatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggcggcagcggcgccaccaatttctcactactgaaacaggccggtgacgtcgaggagaaccccgggcctatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgggaagcggagagggcagaggaagtctgctaacatgcggtgacgtcgaggagaatcctggacctatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaatagaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacggagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccgataacttcgtataggatactttatacgaagttatgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 36 - DNA, 22674 bp, synthetic construct
  misc_feature 1..22674: note = 16P
  source 1..22674: mol_type = other DNA
ttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttaataacttcgtatagcatacattatacgaagttatcggggacagcccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccagcagcccagactgcccagagccacatccagcctggccttgaatgcctgcagggatggggcatccacagcctccttgggcaacctgttcagtgcgtcaccaccctctggggggaaaacttcctcctcatatccaacctaaacctcccctgtctcagtttaaagccattccctcctgtcctatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgaggcacacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcaccccgcacccggcgctcacccgtcccagccccgccgcccgcagccccagctgcaacgcagccaccgccgccatcgcacccggccccgcgggcgcttccgggacgcaggaagcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaagggggcgcggcaggagggggcaccagggagcggagccctggccctcctgacgtcctgcccgcccacgcgtccgcaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgtaggtggtctgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccaccatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgggaggcggaggatctggcggcggaggaagtggcggaggcggaagcggtggtggtggatctgggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagcgtttcagacaaaaagatgatgggaaatgccccttgaatcctcacagccacctaggaacatatggagtttttacaaacgctgcatttgacccgagtcctggcagtggcgccaccaattttagcctgttaaagcaggctggcgacgtggaggagaatcctgggcctatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctaagctcgctttcttgctgtccaatttctattaaaggttcctttgttccccaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaagggggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagctttttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattaagtcagcaagcccatggttactagcgtcccaagcaaacctgtcaacgtgaaacacgtgtgcccagatagaagacgggtagtacctgaagtggttccacttcctttatttggggttgtttcatgaaaatgcttggttgtcctggaaacaggtgtactccgtgttgcttgagcatttggtgtggtggtttttgtggtggttttctgagaagttggtgagacttctgtagttggaacatttactgtggtaggtttctgaactgttggtgggaccttggaagttagagattttcctctgcattcaggtggtgggccactccactctccttcatcattattcacagtacaataaatagagtgctctccaatcatggtgaatcctttattacatgcatacgttacagactgtctatatccataatggtcacgttccccttgaattattccattgtcaatttgtggtggtgctggacaataaatttctctgcactctggcaacgggtcactccactggacagagctgcctgaaataagacaaaaactagaagtcgagccaaataatttgtaccctgtgttacatgagaaggagatggttgcaccaaataatatgccacctggtacatcaatctgaccatttcgtatttctcccggattagggcatgatttctttttacaaaattcgactgctgtggaccattttaaattctgaaggcaagttagttttggtgatagagaaggttctcttctgtaacctggacggcactcatattccacaacagtaccgactggaaaataattctgagtgatataaggctgtttgagggatgcagaatttagccttgttggcacctcgcagctacgattgcagaactcttcaatatctgaccattgactgcccttaaggcagatcactgagtccttctcgccaggaattttcacaaagctttcttcacatttgtacgttattacagtatcctcgggaaaacttgtacggccttccaaagctggctgggcattaggtacatctgggggaaggccacagtcaccccacacggccggcaggcacaacagcaccagcagcagcagccggggcagctccccgaggaggggcagcgccgcgggcacgctcggccgcgcgacggtcataggtccagggttggactccacgtctcccgccaacttgagaaggtcaaaattcaaagtctgtttcactccgcttccgagagaagtaaattttacttctctgtgggtctcatcagttaggtatgtgcctttcttcttcctcctttgaagatatcggtacgggacaacacaaattactgcaactccaacaactatggcaataacaatcacagcaatgacccaaacatccaaactgtcaagtattccttcctcaggtttaggatatcctggataatttgagactggaggcttgtaagtaggcctaggacctgaggcactggacgctggagattttgtagtggaagaagtcgacactgaatgactcaaagctggaggttttgtactagatggaggcagcactttaagacactttggaactgggggatcccaagtactgttactgtcacagacaattgtgtcgctgccatcgaggtaaaaacccttatcgcattcaaacataactgttgctttgtagtaaaatttttttccaaatcctgatatctgttttccattttcgactactggaaatcgacatttgaccactttacactctggagcagcacgactccacactgaattgtcaccacaataaatcgtgctctctccaataagtgaaaatggatctggtccaggtgcaggatcacaactataagttactgcatcaagatactcaaatacttctacttcactaaaggtgtgttttccattcttgatctttggaggtggtgtacacaagaccttctcacatattgggggcttaccgctccaaattgctactgatcctttaagttcacaatacaggatctcctcaccaatcaggtagtaaccctcgttgcagatgaagtgcatctgataaccaaactcgtaagtcccatttgcagggactgcttggccatttaaaggatcccgtatatatggacatgtttctctataacaggcgtcatctgagacaggtagccatgtatgattccgatcacaaatagtatgggtggcaagaggaggtatatagaagtatccttttttacacttataatctactcgttcaccaatctcatagtagggttttggtttgccgatgagctccatagcttcaaatgttggtggctcctcacaggcatcggagaaggagtacagcagcaacaccatggccgccagaagcaacccaggaaagcgccaggaaggaaagggacactcgcggcggccgggaggctccatggtggctcacgacacctgaaatggaagaaaaaaactttgaaccactgtctgaggcttgagaatgaaccaagatccaaactcaaaaagggcaaattccaaggagaattacatcaagtgccaagctggcctaacttcagtctccacccactcagtgtggggaaactccatcgcataaaacccctccccccaacctaaagacgacgtactccaaaagctcgagaactaatcgaggtgcctggacggcgcccggtactccgtggagtcacatgaagcgacggctgaggacggaaaggcccttttcctttgtgtgggtgactcacccgcccgctctcccgagcgccgcgtcctccattttgagctccctgcagcagggccgggaagcggccatctttccgctcacgcaactggtgccgaccgggccagccttgccgcccagggcggggcgatacacggcggcgcgaggccaggcaccagagcaggccggccagcttgagactacccccgtccgattctcggtggccgcgctcgcaggccccgcctcgccgaacatgtgcgctgggacgcacgggccccgtcgccgcccgcggccccaaaaaccgaaataccagtgtgcagatcttggcccgcatttacaagactatcttgccagaaaaaaagcgtcgcagcaggtcatcaaaaattttaaatggctagagacttatcgaaagcagcgagacaggcgcgaaggtgccaccagattcgcacgcggcggccccagcgcccaggccaggcctcaactcaagcacgaggcgaaggggctccttaagcgcaaggcctcgaactctcccacccacttccaacccgaagctcgggatcaagaatcacgtactgcagccaggtggaagtaattcaaggcacgcaagggccataacccgtaaagaggccaggcccgcgggaaccacacacggcacttacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagcctcaggcaccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctcccccacggaggcggctggccgacttccactgaggcgccaacggcctcgccatgcccttttcaataactcattgatttcaaacccgttacgtctatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggccagcgtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgtctcgctccgtggccttagctgtgctcgcgctactctctctttctggcctcgaggctgttatggctccgcggactttaattttaggttgcggcgcttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataaaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacagagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaatgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccgataacttcgtataggatactttatacgaagttatgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 37 - DNA, 25420 bp, synthetic construct
  misc_feature 1..25420: note = 16S
  source 1..25420: mol_type = other DNA
ttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttaataacttcgtatagcatacattatacgaagttatcggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgaggcacacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcaccccgcacccggcgctcacccgtcccagccccgccgcccgcagccccagctgcaacgcagccaccgccgccatcgcacccggccccgcgggcgcttccgggacgcaggaagcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaagggggcgcggcaggagggggcaccagggagcggagccctggccctcctgacgtcctgcccgcccacgcgtccgcaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgtaggtggtctgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccaccatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgtggaagcggagctactaacttcagcctgctgaagcaggctggagacgtggaggagaaccctggacctatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattaagtcagcaagcccatggttactagcgtcccaagcaaacctgtcaacgtgaaacacgtgtgcccagatagaagacgggtagtacctgaagtggttccacttcctttatttggggttgtttcatgaaaatgcttggttgtcctggaaacaggtgtactccgtgttgcttgagcatttggtgtggtggtttttgtggtggttttctgagaagttggtgagacttctgtagttggaacatttactgtggtaggtttctgaactgttggtgggaccttggaagttagagattttcctctgcattcaggtggtgggccactccactctccttcatcattattcacagtacaataaatagagtgctctccaatcatggtgaatcctttattacatgcatacgttacagactgtctatatccataatggtcacgttccccttgaattattccattgtcaatttgtggtggtgctggacaataaatttctctgcactctggcaacgggtcactccactggacagagctgcctgaaataagacaaaaactagaagtcgagccaaataatttgtaccctgtgttacatgagaaggagatggttgcaccaaataatatgccacctggtacatcaatctgaccatttcgtatttctcccggattagggcatgatttctttttacaaaattcgactgctgtggaccattttaaattctgaaggcaagttagttttggtgatagagaaggttctcttctgtaacctggacggcactcatattccacaacagtaccgactggaaaataattctgagtgatataaggctgtttgagggatgcagaatttagccttgttggcacctcgcagctacgattgcagaactcttcaatatctgaccattgactgcccttaaggcagatcactgagtccttctcgccaggaattttcacaaagctttcttcacatttgtacgttattacagtatcctcgggaaaacttgtacggccttccaaagctggctgggcattaggtacatctgggggaaggccacagtcaccccacacggccggcaggcacaacagcaccagcagcagcagccggggcagctccccgaggaggggcagcgccgcgggcacgctcggccgcgcgacggtcataggtccagggttggactccacgtctcccgccaacttgagaaggtcaaaattcaaagtctgtttcactccgcttccgagagaagtaaattttacttctctgtgggtctcatcagttaggtatgtgcctttcttcttcctcctttgaagatatcggtacgggacaacacaaattactgcaactccaacaactatggcaataacaatcacagcaatgacccaaacatccaaactgtcaagtattccttcctcaggtttaggatatcctggataatttgagactggaggcttgtaagtaggcctaggacctgaggcactggacgctggagattttgtagtggaagaagtcgacactgaatgactcaaagctggaggttttgtactagatggaggcagcactttaagacactttggaactgggggatcccaagtactgttactgtcacagacaattgtgtcgctgccatcgaggtaaaaacccttatcgcattcaaacataactgttgctttgtagtaaaatttttttccaaatcctgatatctgttttccattttcgactactggaaatcgacatttgaccactttacactctggagcagcacgactccacactgaattgtcaccacaataaatcgtgctctctccaataagtgaaaatggatctggtccaggtgcaggatcacaactataagttactgcatcaagatactcaaatacttctacttcactaaaggtgtgttttccattcttgatctttggaggtggtgtacacaagaccttctcacatattgggggcttaccgctccaaattgctactgatcctttaagttcacaatacaggatctcctcaccaatcaggtagtaaccctcgttgcagatgaagtgcatctgataaccaaactcgtaagtcccatttgcagggactgcttggccatttaaaggatcccgtatatatggacatgtttctctataacaggcgtcatctgagacaggtagccatgtatgattccgatcacaaatagtatgggtggcaagaggaggtatatagaagtatccttttttacacttataatctactcgttcaccaatctcatagtagggttttggtttgccgatgagctccatagcttcaaatgttggtggctcctcacaggcatcggagaaggagtacagcagcaacaccatggccgccagaagcaacccaggaaagcgccaggaaggaaagggacactcgcggcggccgggaggctccatggtggctcacgacacctgaaatggaagaaaaaaactttgaaccactgtctgaggcttgagaatgaaccaagatccaaactcaaaaagggcaaattccaaggagaattacatcaagtgccaagctggcctaacttcagtctccacccactcagtgtggggaaactccatcgcataaaacccctccccccaacctaaagacgacgtactccaaaagctcgagaactaatcgaggtgcctggacggcgcccggtactccgtggagtcacatgaagcgacggctgaggacggaaaggcccttttcctttgtgtgggtgactcacccgcccgctctcccgagcgccgcgtcctccattttgagctccctgcagcagggccgggaagcggccatctttccgctcacgcaactggtgccgaccgggccagccttgccgcccagggcggggcgatacacggcggcgcgaggccaggcaccagagcaggccggccagcttgagactacccccgtccgattctcggtggccgcgctcgcaggccccgcctcgccgaacatgtgcgctgggacgcacgggccccgtcgccgcccgcggccccaaaaaccgaaataccagtgtgcagatcttggcccgcatttacaagactatcttgccagaaaaaaagcgtcgcagcaggtcatcaaaaattttaaatggctagagacttatcgaaagcagcgagacaggcgcgaaggtgccaccagattcgcacgcggcggccccagcgcccaagccaggcctcaactcaagcacgaggcgaaggggctccttaagcgcaaggcctcgaactctcccacccacttccaacccgaagctcgggatcaagaatcacgtactgcagccaggggcgtggaagtaattcaaggcacgcaagggccataacccgtaaagaggccaggcccgcgggaaccacacacggcacttacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagcctcaccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctcccccacggaggcggctggccgacttccactgaggcgccaacggcctcgccatgcccttttcaataactcattgatttcaaacccgttacgtctatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgtctcgctccgtggccttagctgtgctcgcgctactctctctttctggcctcgaggctgttatggctccgcggactttaattttaggttgcggcgcttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagagggcagaggaagtctgctaacatgcggtgacgtcgaggagaatcctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaatgataacccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgattatatggccacaaccatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggcggcagcggcgccaccaatttctcactactgaaacaggccggtgacgtcgaggagaaccccgggcctatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgtgataaaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacggagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccgataacttcgtataggatactttatacgaagttatgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 38 - DNA, 30963 bp, synthetic construct
  misc_feature 1..30963: note = 17M1
  source 1..30963: mol_type = other DNA
ttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttaataacttcgtatagcatacattatacgaagttatcggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgaggcacacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcaccccgcacccggcgctcacccgtcccagccccgccgcccgcagccccagctgcaacgcagccaccgccgccatcgcacccggccccgcgggcgcttccgggacgcaggaagcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaagggggcgcggcaggagggggcaccagggagcggagccctggccctcctgacgtcctgcccgcccacgcgtccgcaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgtaggtggtcctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactactataccatatctttccagaaatatgaaggcttgtgaaagataagcaagcctatgatggccactgtgaaaaggaccagggagaatagaaccatgaggaagacataggtggagtgggagagaggtgtggacaatggttgctcagctgggatcatgttggtcaggttcagcatgtagcccaaagtccagccggcgtcgctgccctggatcttgccaatgaaatggatgtgctcccaggaatcagctgtgaaatgatagccttgcagaaggagggagagaatgtaggtaccagaaaagcagtattcactcaggtacttctcctttactccagcgtaagatgtttttatctcctcccaaggctgagcacagaactttttcatcatctcagtcaccttttcctgagagactttctctgatgtcaagtttaaaaacttcatcacaaagtaaaaagctgaaaatgccccaaaatccccctggagtggtggcaagaaaatcccattgaaggcacactgggagtaagggcagtaactggtgttgaagagctccaggatgctttgatggcattgttgatagtttccaataccctggatttcaaactgctggaatggaagagtcatctcaaatctcttggtgcagggggtcttgtaaaggtcacttacgttcactaccttcttatatccaggatgaaagcatgggtccctgagaatttcattacttgcaacctgaatgtccttggccagtttctgccagagtgcctgatccttcccatagcacaagaagctatgtgtgtagacattgtagtccttgccatagaggcgaaattgcagagcattatctggggactcgatagtctggttttggggtacaaaagtgacttgtgtagaggctcccccaaggtccaaagctccaaaggtttcctgattattggtttcatatgggactatgctgaaccaccttgttttctgactgaatttgcccagcagatagttgatagtaatccagccataggcaccttcctcttggccagtaatgatcctggcaccctggaagtcaaaggggtagttgctgaggctcctctccaccacatccagaaccctgtctgccaactcttcactttccatcctgagcaaccgcatgcctgccgtggctcccaggtaaacgggtgtctcttggtgctgggaccttggaatcacttccctagctctttccatgcaatcagtcaggtaaatgcctatttcatttactttctgaacaaattttgagattccaggacctttaaccctgcattcttctacttgatgcaccacgcctgtgtcattctccttttctgctggccacttatagatgtataaacttgtgtgagaagaacccgcatccagcacaatcccatacttaacgttttctggcaatgctttgttctgggtcaaccccacagcaagcaaagctatcacagctatgatagaggagaagccaaggatggctaggatattcttggagcaaaatgtcttcacgttagactcctttgtatcttccataggtccagggttgctctcaacatctccagccaatttcaagagagcataattagtacactgtccgcttccgagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagctgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaaccccaggccggccagggccagcgcgccaaggaccaggaccccaagcataggcccaggattctcctccacgtcgccagcctgctttaacaggctaaaattggtggcgccactgccaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcggttgctgaaaaaaagaaaaatctggtttaaaaattcaattaatcaaaatatttccctcatcccttaacagaacacttaaccaggaaaaacgtatggccactgccaagaggtaatagtgcccatcacctcctgtctaagcacgcgcgaggtccagaactagtgctgcagtccaggttgccgtgccaaccgcagcagagcacgccctagatgaaggacccatctacccagacggcgtggggcgttgctcaacacgtggtcttaccccgaactgagcactgtctgttcccctccctcgccaggtgccagtgcccccgggagtcaacgggcttttaactactccggaatgtacccccatactggaagcacgccaagaacagctctgaagaaccacggtgggactggactaagcagggaactgggtgaaagaaaacgctggctccacttccccgcgcgccaggcaaaccgatgcagcaaccctcccccgccacgcggccgccgggcgtctcccagcctcccctggggccactgcggcccactccctacatttccgtcctgccggctgcaaccaaataccgctgccatcccaccgaaaactgaggccctttaagccggtagaaggagccgcacactcgcctcgacgagattctcagaacccccaagcctcagcaagcccaacaggcctgtgtggaggctgcacgctcccagacccacaacccaactcttgagcagaggttttacctggggtgtaggcctggctccaataacgaaggaagccacaaaaaacccaagagctgcaggcgagttcaatgagaccggtttccgcccgccaccctgcctcttataccctatcttagaaccttccagaaggggcccgcccctgctgcctgccattacggcttccccggccaatagacgcccggctgcccttacaagacccaatcacaagcccggctccactcctcgggcctcgcccccttccgcacccaccccaccgcgctccgcctcacgataacgcactcaccgcagcgttctggaactttcaagctcgcccccgctctccggacggccccggggaaagggagggtggggcgcagcgagtccgcgcgcgggagtcctcagttaccccgggcgggggaggggagcgtccacctctacgcatgcgcccccagcttccgcgggagggagggggcggaaaaaggaggaggaagaggggcgggcaaacttggaactaaccaatgatagcggcgctagccgggatcttggccggcacagaactgggggcggaatcgcgcggggcctgaagggaggggtttgggcgcgggagccgggccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctcccccacggaggcggctggccgacttccactgaggcgccaacggcctcgccatgcccttttcaataactcattgatttcaaacccgttacgtctatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgactggcagtggagccaccaacttctcactccttaagcaggctggcgacgtggaggagaaccccgggcctatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctgatagcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgattatatggccacaaccatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggcggcagcggcgccaccaatttctcactactgaaacaggccggtgacgtcgaggagaaccccgggcctatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgggaagcggagagggcagaggaagtctgctaacatgcggtgacgtcgaggagaatcctggacctatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaataactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgactcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccgataacttcgtataggatactttatacgaagttatgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 39 - DNA, 30984 bp, synthetic construct
  misc_feature 1..30984: note = 17M2
  source 1..30984: mol_type = other DNA
ttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttaataacttcgtatagcatacattatacgaagttatcggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgaggcacacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcaccccgcacccggcgctcacccgtcccagccccgccgcccgcagccccagctgcaacgcagccaccgccgccatcgcacccggccccgcgggcgcttccgggacgcaggaagcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaagggggcgcggcaggagggggcaccagggagcggagccctggccctcctgacgtcctgcccgcccacgcgtccgcaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgtaggtggtcctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactactataccatatctttccagaaatatgaaggcttgtgaaagataagcaagcctatgatggccactgtgaaaaggaccagggagaatagaaccatgaggaagacataggtggagtgggagagaggtgtggacaatggttgctcagctgggatcatgttggtcaggttcagcatgtagcccaaagtccagccggcgtcgctgccctggatcttgccaatgaaatggatgtgctcccaggaatcagctgtgaaatgatagccttgcagaaggagggagagaatgtaggtaccagaaaagcagtattcactcaggtacttctcctttactccagcgtaagatgtttttatctcctcccaaggctgagcacagaactttttcatcatctcagtcaccttttcctgagagactttctctgatgtcaagtttaaaaacttcatcacaaagtaaaaagctgaaaatgccccaaaatccccctggagtggtggcaagaaaatcccattgaaggcacactgggagtaagggcagtaactggtgttgaagagctccaggatgctttgatggcattgttgatagtttccaataccctggatttcaaactgctggaatggaagagtcatctcaaatctcttggtgcagggggtcttgtaaaggtcacttacgttcactaccttcttatatccaggatgaaagcatgggtccctgagaatttcattacttgcaacctgaatgtccttggccagtttctgccagagtgcctgatccttcccatagcacaagaagctatgtgtgtagacattgtagtccttgccatagaggcgaaattgcagagcattatctggggactcgatagtctggttttggggtacaaaagtgacttgtgtagaggctcccccaaggtccaaagctccaaaggtttcctgattattggtttcatatgggactatgctgaaccaccttgttttctgactgaatttgcccagcagatagttgatagtaatccagccataggcaccttcctcttggccagtaatgatcctggcaccctggaagtcaaaggggtagttgctgaggctcctctccaccacatccagaaccctgtctgccaactcttcactttccatcctgagcaaccgcatgcctgccgtggctcccaggtaaacgggtgtctcttggtgctgggaccttggaatcacttccctagctctttccatgcaatcagtcaggtaaatgcctatttcatttactttctgaacaaattttgagattccaggacctttaaccctgcattcttctacttgatgcaccacgcctgtgtcattctccttttctgctggccacttatagatgtataaacttgtgtgagaagaacccgcatccagcacaatcccatacttaacgttttctggcaatgctttgttctgggtcaaccccacagcaagcaaagctatcacagctatgatagaggagaagccaaggatggctaggatattcttggagcaaaatgtcttcacgttagactcctttgtatcttccataggtccagggttgctctcaacatctccagccaatttcaagagagcataattagtacactgtccgcttccgagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagctgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaaccccaggccggccagggccagcgcgccaaggaccaggaccccaagcataggcccaggattctcctccacgtcgccagcctgctttaacaggctaaaattggtggcgccactgccaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcggttgctgaaaaaaagaaaaatctggtttaaaaattcaattaatcaaaatatttccctcatcccttaacagaacacttaaccaggaaaaacgtatggccactgccaagaggtaatagtgcccatcacctcctgtctaagcacgcgcgaggtccagaactagtgctgcagtccaggttgccgtgccaaccgcagcagagcacgccctagatgaaggacccatctacccagacggcgtggggcgttgctcaacacgtggtcttaccccgaactgagcactgtctgttcccctccctcgccaggtgccagtgcccccgggagtcaacgggcttttaactactccggaatgtacccccatactggaagcacgccaagaacagctctgaagaaccacggtgggactggactaagcagggaactgggtgaaagaaaacgctggctccacttccccgcgcgccaggcaaaccgatgcagcaaccctcccccgccacgcggccgccgggcgtctcccagcctcccctggggccactgcggcccactccctacatttccgtcctgccggctgcaaccaaataccgctgccatcccaccgaaaactgaggccctttaagccggtagaaggagccgcacactcgcctcgacgagattctcagaacccccaagcctcagcaagcccaacaggcctgtgtggaggctgcacgctcccagacccacaacccaactcttgagcagaggttttacctggggtgtaggcctggctccaataacgaaggaagccacaaaaaacccaagagctgcaggcgagttcaatgagaccggtttccgcccgccaccctgcctcttataccctatcttagaaccttccagaaggggcccgcccctgctgcctgccattacggcttccccggccaatagacgcccggctgcccttacaagacccaatcacaagcccggctccactcctcgggcctcgcccccttccgcacccaccccaccgcgctccgcctcacgataacgcactcaccgcagcgttctggaactttcaagctcgcccccgctctccggacggccccggggaaagggagggtggggcgcagcgagtccgcgcgcgggagtcctcagttaccccgggcgggggaggggagcgtccacctctacgcatgcgcccccagcttccgcgggagggagggggcggaaaaaggaggaggaagaggggcgggcaaacttggaactaaccaatgatagcggcgctagccgggatcttggccggcacagaactgggggcggaatcgcgcggggcctgaagggaggggtttgggcgcgggagccgggccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctcccccacggaggcggctggccgacttccactgaggcgccaacggcctcgccatgcccttttcaataactcattgatttcaaacccgttacgtctatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgactggcagtggagccaccaacttctcactccttaagcaggctggcgacgtggaggagaaccccgggcctatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctgatagcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgattatatggccacaaccatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggcggcagcggcgccaccaatttctcactactgaaacaggccggtgacgtcgaggagaaccccgggcctatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgggaagcggagagggcagaggaagtctgctaacatgcggtgacgtcgaggagaatcctggacctatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaataactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgactcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccgataacttcgtataggatactttatacgaagttatgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 40 - DNA, 23958 bp, synthetic construct
  misc_feature 1..23958: note = 17P
  source 1..23958: mol_type = other DNA
ttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttaataacttcgtatagcatacattatacgaagttatcggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgaggcacacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcaccccgcacccggcgctcacccgtcccagccccgccgcccgcagccccagctgcaacgcagccaccgccgccatcgcacccggccccgcgggcgcttccgggacgcaggaagcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaagggggcgcggcaggagggggcaccagggagcggagccctggccctcctgacgtcctgcccgcccacgcgtccgcaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgtaggtggtcctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgttatggctccgcggactttaattttaggttgcggcgcttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactatcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagctgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaaccccaggccggccagggccagcgcgccaaggaccaggaccccaagcataggtccagggttgctctcaacatctccagccaatttcaagagagcataattagtacactgtccgcttccaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcggttgctgaaaaaaagaaaaatctggtttaaaaattcaattaatcaaaatatttccctcatcccttaacagaacacttaaccaggaaaaacgtatggccactgccaagaggtaatagtgcccatcacctcctgtctaagcacgcgcgaggtccagaactagtgctgcagtccaggttgccgtgccaaccgcagcagagcacgccctagatgaaggacccatctacccagacggcgtggggcgttgctcaacacgtggtcttaccccgaactgagcactgtctgttcccctccctcgccaggtgccagtgcccccgggagtcaacgggcttttaactactccggaatgtacccccatactggaagcacgccaagaacagctctgaagaaccacggtgggactggactaagcagggaactgggtgaaagaaaacgctggctccacttccccgcgcgccaggcaaaccgatgcagcaaccctcccccgccacgcggccgccgggcgtctcccagcctcccctggggccactgcggcccactccctacatttccgtcctgccggctgcaaccaaataccgctgccatcccaccgaaaactgaggccctttaagccggtagaaggagccgcacactcgcctcgacgagattctcagaacccccaagcctcagcaagcccaacaggcctgtgtggaggctgcacgctcccagacccacaacccaactcttgagcagaggttttacctggggtgtaggcctggctccaataacgaaggaagccacaaaaaacccaagagctgcaggcgagttcaatgagaccggtttccgcccgccaccctgcctcttataccctatcttagaaccttccagaaggggcccgcccctgctgcctgccattacggcttccccggccaatagacgcccggctgcccttacaagacccaatcacaagcccggctccactcctcgggcctcgcccccttccgcacccaccccaccgcgctccgcctcacgataacgcactcaccgcagcgttctggaactttcaagctcgcccccgctctccggacggccccggggaaagggagggtggggcgcagcgagtccgcgcgcgggagtcctcagttaccccgggcgggggaggggagcgtccacctctacgcatgcgcccccagcttccgcgggagggagggggcggaaaaaggaggaggaagaggggcgggcaaacttggaactaaccaatgatagcggcgctagccgggatcttggccggcacagaactgggggcggaatcgcgcggggcctgaagggaggggtttgggcgcgggagccgggccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctcccccacggaggcggctggccgacttccactgaggcgccaacggcctcgccatgcccttttcaataactcattgatttcaaacccgttacgtctatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcacttcatctgcaacgagggttactacctgattggtgaggagatcctgtattgtgaacttaaaggatcagtagcaatttggagcggtaagcccccaatatgtgagaaggtcttgtgtacaccacctccaaagatcaagaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagtaaaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacggagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccgataacttcgtataggatactttatacgaagttatgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 41 - DNA, 27981 bp, synthetic construct
  misc_feature 1..27981: note = 17S1
  source 1..27981: mol_type = other DNA
ttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttaataacttcgtatagcatacattatacgaagttatcggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgaggcacacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcaccccgcacccggcgctcacccgtcccagccccgccgcccgcagccccagctgcaacgcagccaccgccgccatcgcacccggccccgcgggcgcttccgggacgcaggaagcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaagggggcgcggcaggagggggcaccagggagcggagccctggccctcctgacgtcctgcccgcccacgcgtccgcaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgtaggtggtcctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactatcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagctgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaaccccaggccggccagggccagcgcgccaaggaccaggaccccaagcataggcccaggattctcctccacgtcgccagcctgctttaacaggctaaaattggtggcgccactgccaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcggttgctgaaaaaaagaaaaatctggtttaaaaattcaattaatcaaaatatttccctcatcccttaacagaacacttaaccaggaaaaacgtatggccactgccaagaggtaatagtgcccatcacctcctgtctaagcacgcgcgaggtccagaactagtgctgcagtccaggttgccgtgccaaccgcagcagagcacgccctagatgaaggacccatctacccagacggcgtggggcgttgctcaacacgtggtcttaccccgaactgagcactgtctgttcccctccctcgccaggtgccagtgcccccgggagtcaacgggcttttaactactccggaatgtacccccatactggaagcacgccaagaacagctctgaagaaccacggtgggactggactaagcagggaactgggtgaaagaaaacgctggctccacttccccgcgcgccaggcaaaccgatgcagcaaccctcccccgccacgcggccgccgggcgtctcccagcctcccctggggccactgcggcccactccctacatttccgtcctgccggctgcaaccaaataccgctgccatcccaccgaaaactgaggccctttaagccggtagaaggagccgcacactcgcctcgacgagattctcagaacccccaagcctcagcaagcccaacaggcctgtgtggaggctgcacgctcccagacccacaacccaactcttgagcagaggttttacctggggtgtaggcctggctccaataacgaaggaagccacaaaaaacccaagagctgcaggcgagttcaatgagaccggtttccgcccgccaccctgcctcttataccctatcttagaaccttccagaaggggcccgcccctgctgcctgccattacggcttccccggccaatagacgcccggctgcccttacaagacccaatcacaagcccggctccactcctcgggcctcgcccccttccgcacccaccccaccgcgctccgcctcacgataacgcactcaccgcagcgttctggaactttcaagctcgcccccgctctccggacggccccggggaaagggagggtggggcgcagcgagtccgcgcgcgggagtcctcagttaccccgggcgggggaggggagcgtccacctctacgcatgcgcccccagcttccgcgggagggagggggcggaaaaaggaggaggaagaggggcgggcaaacttggaactaaccaatgatagcggcgctagccgggatcttggccggcacagaactgggggcggaatcgcgcggggcctgaagggaggggtttgggcgcgggagccgggccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctcccccacggaggcggctggccgacttccactgaggcgccaacggcctcgccatgcccttttcaataactcattgatttcaaacccgttacgtctatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagtagcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgattatatggccacaaccatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggcggcagcggcgccaccaatttctcactactgaaacaggccggtgacgtcgaggagaaccccgggcctatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgtgataactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgactcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccgataacttcgtataggatactttatacgaagttatgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 42 - DNA, 28002 bp, synthetic construct
  misc_feature 1..28002: note = 17S2
  source 1..28002: mol_type = other DNA
ttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttaataacttcgtatagcatacattatacgaagttatcggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgaggcacacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcaccccgcacccggcgctcacccgtcccagccccgccgcccgcagccccagctgcaacgcagccaccgccgccatcgcacccggccccgcgggcgcttccgggacgcaggaagcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaagggggcgcggcaggagggggcaccagggagcggagccctggccctcctgacgtcctgcccgcccacgcgtccgcaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgtaggtggtcctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactatcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagctgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaaccccaggccggccagggccagcgcgccaaggaccaggaccccaagcataggcccaggattctcctccacgtcgccagcctgctttaacaggctaaaattggtggcgccactgccaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcggttgctgaaaaaaagaaaaatctggtttaaaaattcaattaatcaaaatatttccctcatcccttaacagaacacttaaccaggaaaaacgtatggccactgccaagaggtaatagtgcccatcacctcctgtctaagcacgcgcgaggtccagaactagtgctgcagtccaggttgccgtgccaaccgcagcagagcacgccctagatgaaggacccatctacccagacggcgtggggcgttgctcaacacgtggtcttaccccgaactgagcactgtctgttcccctccctcgccaggtgccagtgcccccgggagtcaacgggcttttaactactccggaatgtacccccatactggaagcacgccaagaacagctctgaagaaccacggtgggactggactaagcagggaactgggtgaaagaaaacgctggctccacttccccgcgcgccaggcaaaccgatgcagcaaccctcccccgccacgcggccgccgggcgtctcccagcctcccctggggccactgcggcccactccctacatttccgtcctgccggctgcaaccaaataccgctgccatcccaccgaaaactgaggccctttaagccggtagaaggagccgcacactcgcctcgacgagattctcagaacccccaagcctcagcaagcccaacaggcctgtgtggaggctgcacgctcccagacccacaacccaactcttgagcagaggttttacctggggtgtaggcctggctccaataacgaaggaagccacaaaaaacccaagagctgcaggcgagttcaatgagaccggtttccgcccgccaccctgcctcttataccctatcttagaaccttccagaaggggcccgcccctgctgcctgccattacggcttccccggccaatagacgcccggctgcccttacaagacccaatcacaagcccggctccactcctcgggcctcgcccccttccgcacccaccccaccgcgctccgcctcacgataacgcactcaccgcagcgttctggaactttcaagctcgcccccgctctccggacggccccggggaaagggagggtggggcgcagcgagtccgcgcgcgggagtcctcagttaccccgggcgggggaggggagcgtccacctctacgcatgcgcccccagcttccgcgggagggagggggcggaaaaaggaggaggaagaggggcgggcaaacttggaactaaccaatgatagcggcgctagccgggatcttggccggcacagaactgggggcggaatcgcgcggggcctgaagggaggggtttgggcgcgggagccgggccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctcccccacggaggcggctggccgacttccactgaggcgccaacggcctcgccatgcccttttcaataactcattgatttcaaacccgttacgtctatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagtagcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgattatatggccacaaccatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggcggcagcggcgccaccaatttctcactactgaaacaggccggtgacgtcgaggagaaccccgggcctatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgtgataactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgactcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccgataacttcgtataggatactttatacgaagttatgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 43 - DNA, 33390 bp, synthetic construct
  misc_feature 1..33390: note = 18S1
  source 1..33390: mol_type = other DNA
ggcgtccgggctgactgcagcccgcaggtgagctgggccggccgccttgccctgactcgctgttgtcactcccaaacacggggtcgcgagctaacgttgcagggccccggactccgcgtggggaccccggccccgccccccagcctgtcgagtcaatctgaacgctctgcgacctcgggcgagtccgtcccctcactgcgcggcctcactgccacccctacgcggccggcgctccaaccctgaaaattccagcagcgcacaaggaaaccgtagtgccgggcgcctctcggggtgtaaccaaagcaccggcgccgctcctggcgaggagtgagcgccctggacaagcctgtggctaaacccacgccagccctgatcgctgctcttaactagcatcgtaaacagaagagggtatccccccgaccgcccgaagctggggagccgaccttcaaaaaagtcagggctcccattgtctacctcagtttccctataatgtctacaggtgaccagaatgaaacaaaggcctcactccacaccaccttctcagcacataagggggcggggtagccccaacccggagcgcgcgcctggggacaatcaggcctgtgatttgaggggcagggatgtgtcgggtcgggtagaaaggggcctcggtcttcaaacgaacggagatccggggcagggcgccccgtggagggacctgcatggtggtggctgcgcttggggacgggcgggctgtttcctatggtgaccggggcgaggtgagggctcctgagagctcccccgcgcccagggacgcagagcgtcgcggacccccgccgcgccccttcctcagcccggcactggcgcccgagatcctcgtggagcccgaggggaaagattgcaagggacgtcccagggagcaaagccccgcagcgtggccggggactcggggacccaccccagctccggcgcggccccgccccgggtcaggcagtttcggggcgcagcagggccctccccacggcgcggcagtcccggggaggggccaggcccgtcagcccttcggccctcccggcgaccctcggagggcgccccaactcagacccgcccgccggcccgcgcagggtcgcgagcgcgcgggggtggcgcgggcggggccgttgggaggcggtgcgggctgggggcggggcgggccggggccccacgtgtccctgcccggcgggccaatgggtgcccggctttcggaaagatcgccatatatggacatgttctggggccgcgcgcgccgccgggccgcgcgggcgcgccgcttccgcttaaataacggcgggggaggccgcggtcggtctcagtcgccgctgccagctctcgcactctgttcttccgccgctccgccgtcgcgtttctctgccggtgagcgccccgccccggggcctgagctggacgtcgcaggcctgcgccccccgaccccggctggccccgcttccagctgccgaggcctcgtcgcgccttccccgggaacaaaaggcggggtgggccgggtcaggcggacggggctgggggggcgccgggggtccagggcggggcccggccgcagtgcagacttccgagccgtggacgttacgtaaaaggcccggccttcggttccaggcggttgcgatcttggaggccacggccgctggggttggggcagggccgaggcttccccgcgggagggcattaggtggctgtggggaggggaccgtgttacagacgcgcccgcctgagtccatccttttccgggcaggtcgcagccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagagccatggcttcccgccggaggtggaggagcaggatgatggcacgctgcccatgtcttgtgcccaggagagcgggatggaccgtcaccctgcagcctgtgcttctgctaggatcaatgtgtagtagggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttaccttgtttcgctgaagagcgcccccaatattccgagcctgaccgttaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacggagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgcggggacagccccccccccaaagcccccagggatgtaattgcgtccctctcccgctagggggcagcagcgagccgcccggggctccgctccggcccgacgctccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccagcagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcctatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagataacttcgtatagcatacattatacgaacggtaagttaggggctattgcaattatccagcaagagatcttggaccaggatggcagcagtggaggtggtaaaatgtggttggatgaagcgtacgctttgaaggtatcaacaggaccagctgatggaagggagtcaacaggactagctgatggctgtaaactggggggtcactagctatcagatggcatttacttaaagccatggaagtaggtgagctcccttatggagagggaataggaaggaggtagaccattctatcaaaatgctctttctacagggcacttctcactgagatattatttatctgggatttatattatttattcaatttgttttgtgtttggttctattagaaaagctccataggggccgggcacgttggcttttgcctgtaatcccaacactttggaaggccgaggcaggcggattacctggggtcaggagtttgataccagcctggccaacatggtgaaactctgtctctactaaaaacacaaaaattagccgggcgtggtggtgcgcctgtaatcccagatgctgaggaggagaatcgcttgaacccgggaggtggaggttgcagtgagccgagatcgcgccactgcactccagcctgggcaacaagagcgaaactccctctcaaaaacaaacaaacaaacaaacaaacaaacaaaaaacaaaaaaaagaaagaaagaaagaaaagggccaggtgtggtggctcacacctgtaatcccagcactttgggaggctgaggcaggcggatcacgaggtcaggagatcgataccatcctcaccaacacggtgaaaccctgtctctactaaaaatacaaaaattagtcgggtgtggtggcgggcgcctgtagtcccaggtactccgcaggctgaggcaggagaatcgcttgaacccgggaggcggaggttgtagtgagccgagattgagccactgcactccagcctgggtgacaaagtgagactccatctcaaaagaaaaaagctccataggagaaggaaccttgtctcttcaccacataaactgtgtttggattcgcaatcgagttgggaaaaaaaaatcagtctggaagagccacaccaaaccgctaacagctactgtctctgggaatagaacaaggagtttggttggcgcgatataccgcccctgaacctctagccacaataaggcttaattaatgaccggacgacttgaaagcgccttccactgtttatctcttaaatctgcaacgaaatgcaacaaaaacgcaagaaataaacaatagaagcctcaagagaaatgttctggcacctgcacttgcactggggacagcctattttgctagtttgttttgtttcgttttgttttgatggagagcgtatgttagtactatcgattcacacaaaaaaccaacacacagatgtaatgaaaataaagatattttatttcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcataggtccagggttgctctcaacatctccagccaatttcaagagagcataattagtacactgtccgcttccacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcaagaataggtggtgccaagatcaatgccaactgcaggtcccttagacatggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatgctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactactataccatatctttccagaaatatgaaggcttgtgaaagataagcaagcctatgatggccactgtgaaaaggaccagggagaatagaaccatgaggaagacataggtggagtgggagagaggtgtggacaatggttgctcagctgggatcatgttggtcaggttcagcatgtagcccaaagtccagccggcgtcgctgccctggatcttgccaatgaaatggatgtgctcccaggaatcagctgtgaaatgatagccttgcagaaggagggagagaatgtaggtaccagaaaagcagtattcactcaggtacttctcctttactccagcgtaagatgtttttatctcctcccaaggctgagcacagaactttttcatcatctcagtcaccttttcctgagagactttctctgatgtcaagtttaaaaacttcatcacaaagtaaaaagctgaaaatgccccaaaatccccctggagtggtggcaagaaaatcccattgaaggcacactgggagtaagggcagtaactggtgttgaagagctccaggatgctttgatggcattgttgatagtttccaataccctggatttcaaactgctggaatggaagagtcatctcaaatctcttggtgcagggggtcttgtaaaggtcacttacgttcactaccttcttatatccaggatgaaagcatgggtccctgagaatttcattacttgcaacctgaatgtccttggccagtttctgccagagtgcctgatccttcccatagcacaagaagctatgtgtgtagacattgtagtccttgccatagaggcgaaattgcagagcattatctggggactcgatagtctggttttggggtacaaaagtgacttgtgtagaggctcccccaaggtccaaagctccaaaggtttcctgattattggtttcatatgggactatgctgaaccaccttgttttctgactgaatttgcccagcagatagttgatagtaatccagccataggcaccttcctcttggccagtaatgatcctggcaccctggaagtcaaaggggtagttgctgaggctcctctccaccacatccagaaccctgtctgccaactcttcactttccatcctgagcaaccgcatgcctgccgtggctcccaggtaaacgggtgtctcttggtgctgggaccttggaatcacttccctagctctttccatgcaatcagtcaggtaaatgcctatttcatttactttctgaacaaattttgagattccaggacctttaaccctgcattcttctacttgatgcaccacgcctgtgtcattctccttttctgctggccacttatagatgtataaacttgtgtgagaagaacccgcatccagcacaatcccatacttaacgttttctggcaatgctttgttctgggtcaaccccacagcaagcaaagctatcacagctatgatagaggagaagccaaggatggctaggatattcttggagcaaaatgtcttcacgttagactcctttgtatcttccataggcccaggattctcctccacgtcgccagcctgctttaacaggctaaaattggtggcgccactgccattgatgggaataaaataaggctgaaattgcttttcacattctggctctgttgggggcattttcacatagacccctgttgtaagagggcttcttttctttagcattttgctcaaagaaacagctgtgaggagaaagctataaaaaaacaaccccgaactaactgctgcaaggatccagaggaggaagtcagaatctgggcacggttctggatcaattacataaatctgggttccgttgcctatgcccaggtagtatggcggtgggtacatgagctccaccttgcagatgtagagtcccgtgtccatggccctcagtccttggatagtgaggttcacttgatttccactggaggtgcccgtgcagatggaatcatctaggaaggtcaactcattccccatcatgtaggttgccgcacagacttcagtcacctggctgtcagcctgccgaagcactgtcacccggacctcagtggctttgcctggagatgcatactcacacacaaagctggcgatgcctcggctgctggccagtaccacagcaggctgggccacgtgcattgctttgcagaagacagggatgaagagaagaaaaaacaggagagtgcagggccaggtcctggtagccaggttcagctgagccttgtgccgctgaaatccaaggcaagccatggtggctttcccatttttgcttagcttttagcgatggctttcacgacacctaagacgacaaaaaccttctttaaactactgtcccgacgaccggagactcaggcacaaccccaacagccaagggcaaactccagggagcattagcaccggcgccctgcgggccctgcccggcctacacccagcgaacggggccgccccggcgcccagcccctcccccacccgggccgcgagtcccgggaagcggcgcgggcagcaccgcccggccctttgtgcgccgcccgccgtccgcgtcctccatcttgagaccgggagcggccatctttccgcgctcgcagcccgcccgggcggggcgctgggtctccgaccgcccgccccgccccgccgcggccgtctgccccgggaccgccgggcacggaggccaccttgggcggcctcggctgggccgccctggcagtaacacgcggctgccggccgaactcgagcgcgaagacagacggggcgggcgcgaaggcgcggatcgcacgcggcggccacggcgccccagcaggccgccaccgggcacgcggtagggaaccgcgagagcggagggcctcgagttctccacctccccccgcccgcagctcggaatcaggaccagggcgcagagccctctacgcgcggggggccgggaggcacgctaaggccgtggccaccggcggaggccatgcggacggaggccacacccgtactcacctgtgtcctggcggcaaacccgttgcgaaaaagaacgttcgcggggaccacggcgcttatatatggtcctcccccaccctcggggaaaagggcggagccagcacacgacaccactttcccagtttaccccgcgccacctccacccggcaccggttccaccgccgtcccctccccccatcttcggggaccgtgggcgatgtgcgttcagcccactgacgagcacacggcgcccggcgcatgctcctctcaaccaggaggatgacgactgctggtgggtgggaggcggggtcgagcgctcactcggttctaggtttagtgggagtttatcgacggtccctgggatttccctggctgaggagagtcctccttttgtatgaattactctccgcacagctggggggtggggcggcggggaggcgtccagaatcttccctgaaccggtcgtagcttaactgcaaagttggaccgagatgggagcccttacccggcagtaccccaccggtcctcagtcttgcggtctcgcaggttaaggactaacccctggagccgcttcctctgccggggcttctccaccgcccttgccgtccgcgccccttccggctggagagggaggcgtaaaaggccggggaaccgcggcggcaggggcctcggggcggtcttcagggccgagaatccgcgagtggctcagtttgctgaccaacagcctggcgaacaggctcctgcgctgacctcttggctttttccattcagttcttttatctaagttcgttctacacaccacgtggtactccagacgtccagtttttgagtttagaatagacttaagtactacagttttctttacttctaatcctaattttattacgtttaagaccctgagtgtgtgtctaccctcctattaacattttttttccagtgtatactcttggttgcaagcatgaaaaacctaaaaagaattttttgagttcagtgcttatacacgatctcaagtagagactaagatctacagcgccaggaagcttatccacccaatttactactccaacgtttgctgtgaaatcactgtttctcaaaaatggcctatcccatttgaataaacggcttcatcttttgtcgtcctatccattgtgactgcattttaggcataaatccagggcaagacaagatgaggcctttttggttggcaatcaggcagatattcaaaaatattcctgaagaaagaggaacctttattttaaatgagctaattactagatcgtctcttccacgtgtagagcactactgcaactttttgagccaatctatcaacaaatatttgagaacctactatgtggccagagctaagagtggctccgaagcatatgcaaaagaaatacttcctttgggggaagaaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttaactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgaataacttcgtataggatactttatacgaagttatctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaatgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgatgggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgttggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggaagcgtcgggccggagcggagccccgggcggctcgctgctgccccctagcgggagagggacgcaattacatccctgggggctttggggggggctgtccccgccaatattccgagcctgaccgttccttgtttcgctgaagagcgcccgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 44 - DNA, 34431 bp, synthetic construct
  misc_feature 1..34431: note = 18S2
  source 1..34431: mol_type = other DNA
ggcgtccgggctgactgcagcccgcaggtgagctgggccggccgccttgccctgactcgctgttgtcactcccaaacacggggtcgcgagctaacgttgcagggccccggactccgcgtggggaccccggccccgccccccagcctgtcgagtcaatctgaacgctctgcgacctcgggcgagtccgtcccctcactgcgcggcctcactgccacccctacgcggccggcgctccaaccctgaaaattccagcagcgcacaaggaaaccgtagtgccgggcgcctctcggggtgtaaccaaagcaccggcgccgctcctggcgaggagtgagcgccctggacaagcctgtggctaaacccacgccagccctgatcgctgctcttaactagcatcgtaaacagaagagggtatccccccgaccgcccgaagctggggagccgaccttcaaaaaagtcagggctcccattgtctacctcagtttccctataatgtctacaggtgaccagaatgaaacaaaggcctcactccacaccaccttctcagcacataagggggcggggtagccccaacccggagcgcgcgcctggggacaatcaggcctgtgatttgaggggcagggatgtgtcgggtcgggtagaaaggggcctcggtcttcaaacgaacggagatccggggcagggcgccccgtggagggacctgcatggtggtggctgcgcttggggacgggcgggctgtttcctatggtgaccggggcgaggtgagggctcctgagagctcccccgcgcccagggacgcagagcgtcgcggacccccgccgcgccccttcctcagcccggcactggcgcccgagatcctcgtggagcccgaggggaaagattgcaagggacgtcccagggagcaaagccccgcagcgtggccggggactcggggacccaccccagctccggcgcggccccgccccgggtcaggcagtttcggggcgcagcagggccctccccacggcgcggcagtcccggggaggggccaggcccgtcagcccttcggccctcccggcgaccctcggagggcgccccaactcagacccgcccgccggcccgcgcagggtcgcgagcgcgcgggggtggcgcgggcggggccgttgggaggcggtgcgggctgggggcggggcgggccggggccccacgtgtccctgcccggcgggccaatgggtgcccggctttcggaaagatcgccatatatggacatgttctggggccgcgcgcgccgccgggccgcgcgggcgcgccgcttccgcttaaataacggcgggggaggccgcggtcggtctcagtcgccgctgccagctctcgcactctgttcttccgccgctccgccgtcgcgtttctctgccggtgagcgccccgccccggggcctgagctggacgtcgcaggcctgcgccccccgaccccggctggccccgcttccagctgccgaggcctcgtcgcgccttccccgggaacaaaaggcggggtgggccgggtcaggcggacggggctgggggggcgccgggggtccagggcggggcccggccgcagtgcagacttccgagccgtggacgttacgtaaaaggcccggccttcggttccaggcggttgcgatcttggaggccacggccgctggggttggggcagggccgaggcttccccgcgggagggcattaggtggctgtggggaggggaccgtgttacagacgcgcccgcctgagtccatccttttccgggcaggtcgcagccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagagccatggcttcccgccggaggtggaggagcaggatgatggcacgctgcccatgtcttgtgcccaggagagcgggatggaccgtcaccctgcagcctgtgcttctgctaggatcaatgtgtagtagggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttaccttgtttcgctgaagagcgcccccaatattccgagcctgaccgttaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacggagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgcggggacagccccccccccaaagcccccagggatgtaattgcgtccctctcccgctagggggcagcagcgagccgcccggggctccgctccggcccgacgctccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccagcagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcctatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagataacttcgtatagcatacattatacgaacggtaagttaggggctattgcaattatccagcaagagatcttggaccaggatggcagcagtggaggtggtaaaatgtggttggatgaagcgtacgctttgaaggtatcaacaggaccagctgatggaagggagtcaacaggactagctgatggctgtaaactggggggtcactagctatcagatggcatttacttaaagccatggaagtaggtgagctcccttatggagagggaataggaaggaggtagaccattctatcaaaatgctctttctacagggcacttctcactgagatattatttatctgggatttatattatttattcaatttgttttgtgtttggttctattagaaaagctccataggggccgggcacgttggcttttgcctgtaatcccaacactttggaaggccgaggcaggcggattacctggggtcaggagtttgataccagcctggccaacatggtgaaactctgtctctactaaaaacacaaaaattagccgggcgtggtggtgcgcctgtaatcccagatgctgaggaggagaatcgcttgaacccgggaggtggaggttgcagtgagccgagatcgcgccactgcactccagcctgggcaacaagagcgaaactccctctcaaaaacaaacaaacaaacaaacaaacaaacaaaaaacaaaaaaaagaaagaaagaaagaaaagggccaggtgtggtggctcacacctgtaatcccagcactttgggaggctgaggcaggcggatcacgaggtcaggagatcgataccatcctcaccaacacggtgaaaccctgtctctactaaaaatacaaaaattagtcgggtgtggtggcgggcgcctgtagtcccaggtactccgcaggctgaggcaggagaatcgcttgaacccgggaggcggaggttgtagtgagccgagattgagccactgcactccagcctgggtgacaaagtgagactccatctcaaaagaaaaaagctccataggagaaggaaccttgtctcttcaccacataaactgtgtttggattcgcaatcgagttgggaaaaaaaaatcagtctggaagagccacaccaaaccgctaacagctactgtctctgggaatagaacaaggagtttggttggcgcgatataccgcccctgaacctctagccacaataaggcttaattaatgaccggacgacttgaaagcgccttccactgtttatctcttaaatctgcaacgaaatgcaacaaaaacgcaagaaataaacaatagaagcctcaagagaaatgttctggcacctgcacttgcactggggacagcctattttgctagtttgttttgtttcgttttgttttgatggagagcgtatgttagtactatcgattcacacaaaaaaccaacacacagatgtaatgaaaataaagatattttatttcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcataggtccagggttgctctcaacatctccagccaatttcaagagagcataattagtacactgtccgcttccacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcaagaataggtggtgccaagatcaatgccaactgcaggtcccttagacatggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatgctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattacgtctcctccaaatgtgtatcactttgcttctttgagtttgtatcttggatgccacattttttcacatccatcattctcccttttcttaaacggaagatgaatgtcagtgctacaccaaggcataataagatggctcccagaattaccaagtgagtcctttcatttggaggatgtgccagaggtagttctgggatgaccaattcagctgtatggttttcctcaggatctaatctcctaaaagtgcagtagaaaatctcattagttgttgtgttgattctcagtgtgctggtcacattgaaaagcttctcctctctcttggaattggtggtggtggtcttaccactcaggacttgatggtcactgcttgtccagatgacttcggccttggggtagccctcagcctgacatgtcagttcatgttcagaggtgactggatccacaaccaaaattctttggttgattttgttgtatggggcattgactttcacagtaattcgcttgtagtcggcaccaccatagctgatcatgcagcggtacacccctgcatcctgcaatttcacatctgtgatctgaagtgcagcatttcccagggagagctggtccttcaacagccgggccctctgtctgtagctactatgctgaaccttcaggtcttcctctccatgcacaaattgaataatgttcttatcctccatttcccaatagacaattagtgcagccaggtctaattgtttttctactgggaatttgcattcaattgtcatattgctaccatactctaccacatataggtccttgggaaccgtgacagtaaatgcgttcagcaaatgccagtaggtcatgaatataaagacagcaaatatcctcataggcccaggattctcctccacgtcgccagcctgctttaacaggctaaaattggtggcgccactgccgccatacatctgcttgaactgaaagcattcgttgcagtagccgttgcacttggcattgccaaaatgatcacaggcgggggcccggcaacgctgcttgggggggtcttcgggggcaggctcaccccggtgggccccagggcccatcctctggttgggatgctgacactccatgcagagctcctcgctgcggcaggccaggatgttcttgcaggaggcccgggcgcacttgggccttgaggtgctttgtgtggttcgaggcacatctctgcgctggctcgatctcagttgctcttctgtccttttggcctcatgaaatctctgattctgagcttcaatgaaacacttctggcagtatccttcaaacatggtgcttccaagggtgccgcattccctccccaggcacggaatggtgttctggaacctggacgctgtgggactgactttccctgaggcagcagcaaaatgtttgttttctctgtactcgatgaaacacagtgtgcaaaagcccttgttttctggagtcccaaaatacacgcagccggcttttctgcacttgctcgtccccgtcctgtccccaggagtccgtgcagcttgagacaggcagccagcaggggcgtcgtttccagctctgtggcaagaatgcggggaggggctccggacgagccgcgagggatctgacttggaacgctggtgacaggaaggagggaggctggtgctgaggctggaggaggcctctgctgtagtccttttgaagcaagtactgcagatcccattaaatgtcctggtaacatcctggaggcaggcttggcacttcccgggatccaagtgccttgtgtggtctggggcgtggctggcgtgaagttgccgggcgttgtggcaacgttcacaaaatccgttgtgctgcacattcagtgtgaaggggcagccggggctcctgcacttcatggcagtggtctcactgaacagaaaagggctgggtgctgtcggtggggccgaatgaggccccccagtggactcctcagggttccacgccaagggctcataggcttctccccgagaggccccgagcgccatgccagggagcccctcagggcccggcttggagttcagctttgggagtttgttttgattcttttgccgcctctctgagcactcatggcataaaggctgggtgttcacagacatgaagaaggggcagttgggcgtttcacattttacatccatgagagaaagctggggcacggaaggttccatgggattctgggcgtgcccctctctcctcccctgctcgctgttttcctgccatttcttgtactcatgctgaacaagttcaaagtaatcatctaccagattgatttcttttggtaagttagcttcatccaactttgcggcattgatgagatgagttgtgccatggtcccagccttggacggggatttctatcaccattaagtactcttttaagagcttctccttcatctcattttcaggatctgtcaaaaagtgaacttttaagtcttcaaatcttccccggtctctgttaacaagtggaacagctcggatttcaggcccactgtccttcagggtcaccaagggtacaaaatgatggctgtcatagccgagaacaatggggtatctgtagcattcctgggcaggccagtggagaggcaagtaaattccacccactttcaaaggggcgaaattggaacctgattccaaacttcttagcattttgtctgaaatgacaatgattggccttctgaggatgttgcaaaggacaaatatgtgtatttcttccagtgagttgtactgaagtccacttcgggccatgggtgtgtctgtggaagccattttgataagattgtcccattcatcattccagttccgagtatcatagcaaagccccgtttcaacaaattcctgagatttgagagactccagttgccagcggaatttaaagttgcgtgtgtctgtttccttgagcgtgctgaacagcgccttcctcagtaccaagtctgtgtcctgaacgccccacatgtactgagaagtggcatgcatgaggcaattgccgtcaccgttcgttttcagcgccacaagcttccggacttctcgacaccagttgagtttcttctggctttccagggtggcctggatgtttctgtcgatgagggctttgtggatgatctcccgaaactgaggacaaaactggcaagttctgaacatttccagtgtgtatcggtgcatggttttaaaatgatgaatgatcccattagtaggtttaaaaatgtcttctggagttctctcccgtatcttcacagctttccgcatattgctcaaatacaaagcctgaggaaggacttgttcagccatggtggctttcccatttttgcttagcttttagcgatggctttcacgacacctaagacgacaaaaaccttctttaaactactgtcccgacgaccggagactcaggcacaaccccaacagccaagggcaaactccagggagcattagcaccggcgccctgcgggccctgcccggcctacacccagcgaacggggccgccccggcgcccagcccctcccccacccgggccgcgagtcccgggaagcggcgcgggcagcaccgcccggccctttgtgcgccgcccgccgtccgcgtcctccatcttgagaccgggagcggccatctttccgcgctcgcagcccgcccgggcggggcgctgggtctccgaccgcccgccccgccccgccgcggccgtctgccccgggaccgccgggcacggaggccaccttgggcggcctcggctgggccgccctggcagtaacacgcggctgccggccgaactcgagcgcgaagacagacggggcgggcgcgaaggcgcggatcgcacgcggcggccacggcgccccagcaggccgccaccgggcacgcggtagggaaccgcgagagcggagggcctcgagttctccacctccccccgcccgcagctcggaatcaggaccagggcgcagagccctctacgcgcggggggccgggaggcacgctaaggccgtggccaccggcggaggccatgcggacggaggccacacccgtactcacctgtgtcctggcggcaaacccgttgcgaaaaagaacgttcgcggggaccacggcgcttatatatggtcctcccccaccctcggggaaaagggcggagccagcacacgacaccactttcccagtttaccccgcgccacctccacccggcaccggttccaccgccgtcccctccccccatcttcggggaccgtgggcgatgtgcgttcagcccactgacgagcacacggcgcccggcgcatgctcctctcaaccaggaggatgacgactgctggtgggtgggaggcggggtcgagcgctcactcggttctaggtttagtgggagtttatcgacggtccctgggatttccctggctgaggagagtcctccttttgtatgaattactctccgcacagctggggggtggggcggcggggaggcgtccagaatcttccctgaaccggtcgtagcttaactgcaaagttggaccgagatgggagcccttacccggcagtaccccaccggtcctcagtcttgcggtctcgcaggttaaggactaacccctggagccgcttcctctgccggggcttctccaccgcccttgccgtccgcgccccttccggctggagagggaggcgtaaaaggccggggaaccgcggcggcaggggcctcggggcggtcttcagggccgagaatccgcgagtggctcagtttgctgaccaacagcctggcgaacaggctcctgcgctgacctcttggctttttccattcagttcttttatctaagttcgttctacacaccacgtggtactccagacgtccagtttttgagtttagaatagacttaagtactacagttttctttacttctaatcctaattttattacgtttaagaccctgagtgtgtgtctaccctcctattaacattttttttccagtgtatactcttggttgcaagcatgaaaaacctaaaaagaattttttgagttcagtgcttatacacgatctcaagtagagactaagatctacagcgccaggaagcttatccacccaatttactactccaacgtttgctgtgaaatcactgtttctcaaaaatggcctatcccatttgaataaacggcttcatcttttgtcgtcctatccattgtgactgcattttaggcataaatccagggcaagacaagatgaggcctttttggttggcaatcaggcagatattcaaaaatattcctgaagaaagaggaacctttattttaaatgagctaattactagatcgtctcttccacgtgtagagcactactgcaactttttgagccaatctatcaacaaatatttgagaacctactatgtggccagagctaagagtggctccgaagcatatgcaaaagaaatacttcctttgggggaagaaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttaactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgaataacttcgtataggatactttatacgaagttatctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaatgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgatgggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgttggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggaagcgtcgggccggagcggagccccgggcggctcgctgctgccccctagcgggagagggacgcaattacatccctgggggctttggggggggctgtccccgccaatattccgagcctgaccgttccttgtttcgctgaagagcgcccgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 45 - DNA, 34212 bp, synthetic construct
  misc_feature 1..34212: note = 18S3
  source 1..34212: mol_type = other DNA
ggcgtccgggctgactgcagcccgcaggtgagctgggccggccgccttgccctgactcgctgttgtcactcccaaacacggggtcgcgagctaacgttgcagggccccggactccgcgtggggaccccggccccgccccccagcctgtcgagtcaatctgaacgctctgcgacctcgggcgagtccgtcccctcactgcgcggcctcactgccacccctacgcggccggcgctccaaccctgaaaattccagcagcgcacaaggaaaccgtagtgccgggcgcctctcggggtgtaaccaaagcaccggcgccgctcctggcgaggagtgagcgccctggacaagcctgtggctaaacccacgccagccctgatcgctgctcttaactagcatcgtaaacagaagagggtatccccccgaccgcccgaagctggggagccgaccttcaaaaaagtcagggctcccattgtctacctcagtttccctataatgtctacaggtgaccagaatgaaacaaaggcctcactccacaccaccttctcagcacataagggggcggggtagccccaacccggagcgcgcgcctggggacaatcaggcctgtgatttgaggggcagggatgtgtcgggtcgggtagaaaggggcctcggtcttcaaacgaacggagatccggggcagggcgccccgtggagggacctgcatggtggtggctgcgcttggggacgggcgggctgtttcctatggtgaccggggcgaggtgagggctcctgagagctcccccgcgcccagggacgcagagcgtcgcggacccccgccgcgccccttcctcagcccggcactggcgcccgagatcctcgtggagcccgaggggaaagattgcaagggacgtcccagggagcaaagccccgcagcgtggccggggactcggggacccaccccagctccggcgcggccccgccccgggtcaggcagtttcggggcgcagcagggccctccccacggcgcggcagtcccggggaggggccaggcccgtcagcccttcggccctcccggcgaccctcggagggcgccccaactcagacccgcccgccggcccgcgcagggtcgcgagcgcgcgggggtggcgcgggcggggccgttgggaggcggtgcgggctgggggcggggcgggccggggccccacgtgtccctgcccggcgggccaatgggtgcccggctttcggaaagatcgccatatatggacatgttctggggccgcgcgcgccgccgggccgcgcgggcgcgccgcttccgcttaaataacggcgggggaggccgcggtcggtctcagtcgccgctgccagctctcgcactctgttcttccgccgctccgccgtcgcgtttctctgccggtgagcgccccgccccggggcctgagctggacgtcgcaggcctgcgccccccgaccccggctggccccgcttccagctgccgaggcctcgtcgcgccttccccgggaacaaaaggcggggtgggccgggtcaggcggacggggctgggggggcgccgggggtccagggcggggcccggccgcagtgcagacttccgagccgtggacgttacgtaaaaggcccggccttcggttccaggcggttgcgatcttggaggccacggccgctggggttggggcagggccgaggcttccccgcgggagggcattaggtggctgtggggaggggaccgtgttacagacgcgcccgcctgagtccatccttttccgggcaggtcgcagccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagagccatggcttcccgccggaggtggaggagcaggatgatggcacgctgcccatgtcttgtgcccaggagagcgggatggaccgtcaccctgcagcctgtgcttctgctaggatcaatgtgtagtagggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttaccttgtttcgctgaagagcgcccccaatattccgagcctgaccgttaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacggagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgcggggacagccccccccccaaagcccccagggatgtaattgcgtccctctcccgctagggggcagcagcgagccgcccggggctccgctccggcccgacgctccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccagcagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcctatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagataacttcgtatagcatacattatacgaacggtaagttaggggctattgcaattatccagcaagagatcttggaccaggatggcagcagtggaggtggtaaaatgtggttggatgaagcgtacgctttgaaggtatcaacaggaccagctgatggaagggagtcaacaggactagctgatggctgtaaactggggggtcactagctatcagatggcatttacttaaagccatggaagtaggtgagctcccttatggagagggaataggaaggaggtagaccattctatcaaaatgctctttctacagggcacttctcactgagatattatttatctgggatttatattatttattcaatttgttttgtgtttggttctattagaaaagctccataggggccgggcacgttggcttttgcctgtaatcccaacactttggaaggccgaggcaggcggattacctggggtcaggagtttgataccagcctggccaacatggtgaaactctgtctctactaaaaacacaaaaattagccgggcgtggtggtgcgcctgtaatcccagatgctgaggaggagaatcgcttgaacccgggaggtggaggttgcagtgagccgagatcgcgccactgcactccagcctgggcaacaagagcgaaactccctctcaaaaacaaacaaacaaacaaacaaacaaacaaaaaacaaaaaaaagaaagaaagaaagaaaagggccaggtgtggtggctcacacctgtaatcccagcactttgggaggctgaggcaggcggatcacgaggtcaggagatcgataccatcctcaccaacacggtgaaaccctgtctctactaaaaatacaaaaattagtcgggtgtggtggcgggcgcctgtagtcccaggtactccgcaggctgaggcaggagaatcgcttgaacccgggaggcggaggttgtagtgagccgagattgagccactgcactccagcctgggtgacaaagtgagactccatctcaaaagaaaaaagctccataggagaaggaaccttgtctcttcaccacataaactgtgtttggattcgcaatcgagttgggaaaaaaaaatcagtctggaagagccacaccaaaccgctaacagctactgtctctgggaatagaacaaggagtttggttggcgcgatataccgcccctgaacctctagccacaataaggcttaattaatgaccggacgacttgaaagcgccttccactgtttatctcttaaatctgcaacgaaatgcaacaaaaacgcaagaaataaacaatagaagcctcaagagaaatgttctggcacctgcacttgcactggggacagcctattttgctagtttgttttgtttcgttttgttttgatggagagcgtatgttagtactatcgattcacacaaaaaaccaacacacagatgtaatgaaaataaagatattttatttcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcataggtccagggttgctctcaacatctccagccaatttcaagagagcataattagtacactgtccgcttccacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcaagaataggtggtgccaagatcaatgccaactgcaggtcccttagacatggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatgctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactactataccatatctttccagaaatatgaaggcttgtgaaagataagcaagcctatgatggccactgtgaaaaggaccagggagaatagaaccatgaggaagacataggtggagtgggagagaggtgtggacaatggttgctcagctgggatcatgttggtcaggttcagcatgtagcccaaagtccagccggcgtcgctgccctggatcttgccaatgaaatggatgtgctcccaggaatcagctgtgaaatgatagccttgcagaaggagggagagaatgtaggtaccagaaaagcagtattcactcaggtacttctcctttactccagcgtaagatgtttttatctcctcccaaggctgagcacagaactttttcatcatctcagtcaccttttcctgagagactttctctgatgtcaagtttaaaaacttcatcacaaagtaaaaagctgaaaatgccccaaaatccccctggagtggtggcaagaaaatcccattgaaggcacactgggagtaagggcagtaactggtgttgaagagctccaggatgctttgatggcattgttgatagtttccaataccctggatttcaaactgctggaatggaagagtcatctcaaatctcttggtgcagggggtcttgtaaaggtcacttacgttcactaccttcttatatccaggatgaaagcatgggtccctgagaatttcattacttgcaacctgaatgtccttggccagtttctgccagagtgcctgatccttcccatagcacaagaagctatgtgtgtagacattgtagtccttgccatagaggcgaaattgcagagcattatctggggactcgatagtctggttttggggtacaaaagtgacttgtgtagaggctcccccaaggtccaaagctccaaaggtttcctgattattggtttcatatgggactatgctgaaccaccttgttttctgactgaatttgcccagcagatagttgatagtaatccagccataggcaccttcctcttggccagtaatgatcctggcaccctggaagtcaaaggggtagttgctgaggctcctctccaccacatccagaaccctgtctgccaactcttcactttccatcctgagcaaccgcatgcctgccgtggctcccaggtaaacgggtgtctcttggtgctgggaccttggaatcacttccctagctctttccatgcaatcagtcaggtaaatgcctatttcatttactttctgaacaaattttgagattccaggacctttaaccctgcattcttctacttgatgcaccacgcctgtgtcattctccttttctgctggccacttatagatgtataaacttgtgtgagaagaacccgcatccagcacaatcccatacttaacgttttctggcaatgctttgttctgggtcaaccccacagcaagcaaagctatcacagctatgatagaggagaagccaaggatggctaggatattcttggagcaaaatgtcttcacgttagactcctttgtatcttccataggcccaggattctcctccacgtcgccagcctgctttaacaggctaaaattggtggcgccactgccagacataaaaattttttgcttgaaagtaatgactgtgtagcacatgggacacttgtcaactgcttcagcacattgtttacaagtgactagatgtccacaaggaacaaaaacgatagcaatatttctatccatacagattttgcaaagcttctcctcttgcaggcgccttagctgctcttcagtactaatctctttctgtaatgaagtctgacttgactcatcttgcatactgtctttctgagcattcactagatctgcaaccagaacctcaagtgatttatagttgctcccagatatctgaattttttcctccattattttcttaatgtccttgaaactgaaccccattcgtatagcttcttgtaccataggattttggaagatggtatcatcaattcttctagttagtgatggtgttttctcagtagttcttaccagacactcctcaagtgaatgagttaaatgaatattgtttatatattcttgtcccttctgttctaacagatatttgcaccctggataccatttagcatgttgttcccaagggtcttcactgggcttccaatcagttagccctcctccacagtgaaagcactttactttatcaccttcacctaaagcataaaatccagctcttgcaagctgctccttgttaactgagtatatccatgtcccaaaagtaaagatccgtgcttcataatctgccatggatggatttcttggaagatttgttgaatttgggaaattcctatcagaactcacagcatcagattcacttcgaatattaagattccggcccaaaacaaagaagcaattaggaaagtgtcgcctgtgttctgaccaggcacgatcacaaggttcccaatttttcagttttccaccacaacaaaagcactgcacttggtcaccaatacctgtgtagtagagtccagcacttgctaactctcttggggttaggtgagcatagtctggccagttctgaaaggactttaatctagcttcttcactatacatggcagggttcctcgggtatatggtgtctgatatatctacaacctgcccagttctcaaaagatagtctgcatgtgtctcagatggcctgtctaaggcaaaatgatctctgcttcccagatagttttcaactttgtactgaccattctggataccagaatttgtagactgcgtggcactattttcaagataaaagccgttgataaatctgcaatttggggatactttcctgtgtcttccaactgctgagtctccatattgccatctatctacagctgcatgacaactaaagcaccgcacggtatctccttcaccagtataaagaaaccctgctcgtgccagtgttgatgctgaaacaggactaccacttggaaaattagcaaaagtttttaatctattaaactcttctacaaattcttcttccttattgatgtctgcaggtacacaagttttagatccttcaaaactgttaaaagtcatggtggctttcccatttttgcttagcttttagcgatggctttcacgacacctaagacgacaaaaaccttctttaaactactgtcccgacgaccggagactcaggcacaaccccaacagccaagggcaaactccagggagcattagcaccggcgccctgcgggccctgcccggcctacacccagcgaacggggccgccccggcgcccagcccctcccccacccgggccgcgagtcccgggaagcggcgcgggcagcaccgcccggccctttgtgcgccgcccgccgtccgcgtcctccatcttgagaccgggagcggccatctttccgcgctcgcagcccgcccgggcggggcgctgggtctccgaccgcccgccccgccccgccgcggccgtctgccccgggaccgccgggcacggaggccaccttgggcggcctcggctgggccgccctggcagtaacacgcggctgccggccgaactcgagcgcgaagacagacggggcgggcgcgaaggcgcggatcgcacgcggcggccacggcgccccagcaggccgccaccgggcacgcggtagggaaccgcgagagcggagggcctcgagttctccacctccccccgcccgcagctcggaatcaggaccagggcgcagagccctctacgcgcggggggccgggaggcacgctaaggccgtggccaccggcggaggccatgcggacggaggccacacccgtactcacctgtgtcctggcggcaaacccgttgcgaaaaagaacgttcgcggggaccacggcgcttatatatggtcctcccccaccctcggggaaaagggcggagccagcacacgacaccactttcccagtttaccccgcgccacctccacccggcaccggttccaccgccgtcccctccccccatcttcggggaccgtgggcgatgtgcgttcagcccactgacgagcacacggcgcccggcgcatgctcctctcaaccaggaggatgacgactgctggtgggtgggaggcggggtcgagcgctcactcggttctaggtttagtgggagtttatcgacggtccctgggatttccctggctgaggagagtcctccttttgtatgaattactctccgcacagctggggggtggggcggcggggaggcgtccagaatcttccctgaaccggtcgtagcttaactgcaaagttggaccgagatgggagcccttacccggcagtaccccaccggtcctcagtcttgcggtctcgcaggttaaggactaacccctggagccgcttcctctgccggggcttctccaccgcccttgccgtccgcgccccttccggctggagagggaggcgtaaaaggccggggaaccgcggcggcaggggcctcggggcggtcttcagggccgagaatccgcgagtggctcagtttgctgaccaacagcctggcgaacaggctcctgcgctgacctcttggctttttccattcagttcttttatctaagttcgttctacacaccacgtggtactccagacgtccagtttttgagtttagaatagacttaagtactacagttttctttacttctaatcctaattttattacgtttaagaccctgagtgtgtgtctaccctcctattaacattttttttccagtgtatactcttggttgcaagcatgaaaaacctaaaaagaattttttgagttcagtgcttatacacgatctcaagtagagactaagatctacagcgccaggaagcttatccacccaatttactactccaacgtttgctgtgaaatcactgtttctcaaaaatggcctatcccatttgaataaacggcttcatcttttgtcgtcctatccattgtgactgcattttaggcataaatccagggcaagacaagatgaggcctttttggttggcaatcaggcagatattcaaaaatattcctgaagaaagaggaacctttattttaaatgagctaattactagatcgtctcttccacgtgtagagcactactgcaactttttgagccaatctatcaacaaatatttgagaacctactatgtggccagagctaagagtggctccgaagcatatgcaaaagaaatacttcctttgggggaagaaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttaactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgaataacttcgtataggatactttatacgaagttatctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaatgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgatgggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgttggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggaagcgtcgggccggagcggagccccgggcggctcgctgctgccccctagcgggagagggacgcaattacatccctgggggctttggggggggctgtccccgccaatattccgagcctgaccgttccttgtttcgctgaagagcgcccgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 46 - DNA, 34230 bp, synthetic construct
  misc_feature 1..34230: note = 18S4
  source 1..34230: mol_type = other DNA
ggcgtccgggctgactgcagcccgcaggtgagctgggccggccgccttgccctgactcgctgttgtcactcccaaacacggggtcgcgagctaacgttgcagggccccggactccgcgtggggaccccggccccgccccccagcctgtcgagtcaatctgaacgctctgcgacctcgggcgagtccgtcccctcactgcgcggcctcactgccacccctacgcggccggcgctccaaccctgaaaattccagcagcgcacaaggaaaccgtagtgccgggcgcctctcggggtgtaaccaaagcaccggcgccgctcctggcgaggagtgagcgccctggacaagcctgtggctaaacccacgccagccctgatcgctgctcttaactagcatcgtaaacagaagagggtatccccccgaccgcccgaagctggggagccgaccttcaaaaaagtcagggctcccattgtctacctcagtttccctataatgtctacaggtgaccagaatgaaacaaaggcctcactccacaccaccttctcagcacataagggggcggggtagccccaacccggagcgcgcgcctggggacaatcaggcctgtgatttgaggggcagggatgtgtcgggtcgggtagaaaggggcctcggtcttcaaacgaacggagatccggggcagggcgccccgtggagggacctgcatggtggtggctgcgcttggggacgggcgggctgtttcctatggtgaccggggcgaggtgagggctcctgagagctcccccgcgcccagggacgcagagcgtcgcggacccccgccgcgccccttcctcagcccggcactggcgcccgagatcctcgtggagcccgaggggaaagattgcaagggacgtcccagggagcaaagccccgcagcgtggccggggactcggggacccaccccagctccggcgcggccccgccccgggtcaggcagtttcggggcgcagcagggccctccccacggcgcggcagtcccggggaggggccaggcccgtcagcccttcggccctcccggcgaccctcggagggcgccccaactcagacccgcccgccggcccgcgcagggtcgcgagcgcgcgggggtggcgcgggcggggccgttgggaggcggtgcgggctgggggcggggcgggccggggccccacgtgtccctgcccggcgggccaatgggtgcccggctttcggaaagatcgccatatatggacatgttctggggccgcgcgcgccgccgggccgcgcgggcgcgccgcttccgcttaaataacggcgggggaggccgcggtcggtctcagtcgccgctgccagctctcgcactctgttcttccgccgctccgccgtcgcgtttctctgccggtgagcgccccgccccggggcctgagctggacgtcgcaggcctgcgccccccgaccccggctggccccgcttccagctgccgaggcctcgtcgcgccttccccgggaacaaaaggcggggtgggccgggtcaggcggacggggctgggggggcgccgggggtccagggcggggcccggccgcagtgcagacttccgagccgtggacgttacgtaaaaggcccggccttcggttccaggcggttgcgatcttggaggccacggccgctggggttggggcagggccgaggcttccccgcgggagggcattaggtggctgtggggaggggaccgtgttacagacgcgcccgcctgagtccatccttttccgggcaggtcgcagccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagagccatggcttcccgccggaggtggaggagcaggatgatggcacgctgcccatgtcttgtgcccaggagagcgggatggaccgtcaccctgcagcctgtgcttctgctaggatcaatgtgtagtagggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttaccttgtttcgctgaagagcgcccccaatattccgagcctgaccgttaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacggagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgcggggacagccccccccccaaagcccccagggatgtaattgcgtccctctcccgctagggggcagcagcgagccgcccggggctccgctccggcccgacgctccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccagcagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcctatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagataacttcgtatagcatacattatacgaacggtaagttaggggctattgcaattatccagcaagagatcttggaccaggatggcagcagtggaggtggtaaaatgtggttggatgaagcgtacgctttgaaggtatcaacaggaccagctgatggaagggagtcaacaggactagctgatggctgtaaactggggggtcactagctatcagatggcatttacttaaagccatggaagtaggtgagctcccttatggagagggaataggaaggaggtagaccattctatcaaaatgctctttctacagggcacttctcactgagatattatttatctgggatttatattatttattcaatttgttttgtgtttggttctattagaaaagctccataggggccgggcacgttggcttttgcctgtaatcccaacactttggaaggccgaggcaggcggattacctggggtcaggagtttgataccagcctggccaacatggtgaaactctgtctctactaaaaacacaaaaattagccgggcgtggtggtgcgcctgtaatcccagatgctgaggaggagaatcgcttgaacccgggaggtggaggttgcagtgagccgagatcgcgccactgcactccagcctgggcaacaagagcgaaactccctctcaaaaacaaacaaacaaacaaacaaacaaacaaaaaacaaaaaaaagaaagaaagaaagaaaagggccaggtgtggtggctcacacctgtaatcccagcactttgggaggctgaggcaggcggatcacgaggtcaggagatcgataccatcctcaccaacacggtgaaaccctgtctctactaaaaatacaaaaattagtcgggtgtggtggcgggcgcctgtagtcccaggtactccgcaggctgaggcaggagaatcgcttgaacccgggaggcggaggttgtagtgagccgagattgagccactgcactccagcctgggtgacaaagtgagactccatctcaaaagaaaaaagctccataggagaaggaaccttgtctcttcaccacataaactgtgtttggattcgcaatcgagttgggaaaaaaaaatcagtctggaagagccacaccaaaccgctaacagctactgtctctgggaatagaacaaggagtttggttggcgcgatataccgcccctgaacctctagccacaataaggcttaattaatgaccggacgacttgaaagcgccttccactgtttatctcttaaatctgcaacgaaatgcaacaaaaacgcaagaaataaacaatagaagcctcaagagaaatgttctggcacctgcacttgcactggggacagcctattttgctagtttgttttgtttcgttttgttttgatggagagcgtatgttagtactatcgattcacacaaaaaaccaacacacagatgtaatgaaaataaagatattttatttcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcataggtccagggttgctctcaacatctccagccaatttcaagagagcataattagtacactgtccgcttccacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcaagaataggtggtgccaagatcaatgccaactgcaggtcccttagacatggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatgctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattaattgatgggaataaaataaggctgaaattgcttttcacattctggctctgttgggggcattttcacatagacccctgttgtaagagggcttcttttctttagcattttgctcaaagaaacagctgtgaggagaaagctataaaaaaacaaccccgaactaactgctgcaaggatccagaggaggaagtcagaatctgggcacggttctggatcaattacataaatctgggttccgttgcctatgcccaggtagtatggcggtgggtacatgagctccaccttgcagatgtagagtcccgtgtccatggccctcagtccttggatagtgaggttcacttgatttccactggaggtgcccgtgcagatggaatcatctaggaaggtcaactcattccccatcatgtaggttgccgcacagacttcagtcacctggctgtcagcctgccgaagcactgtcacccggacctcagtggctttgcctggagatgcatactcacacacaaagctggcgatgcctcggctgctggccagtaccacagcaggctgggccacgtgcattgctttgcagaagacagggatgaagagaagaaaaaacaggagagtgcagggccaggtcctggtagccaggttcagctgagccttgtgccgctgaaatccaaggcaagccataggcccaggattctcctccacgtcgccagcctgctttaacaggctaaaattggtggcgccactgccgccatacatctgcttgaactgaaagcattcgttgcagtagccgttgcacttggcattgccaaaatgatcacaggcgggggcccggcaacgctgcttgggggggtcttcgggggcaggctcaccccggtgggccccagggcccatcctctggttgggatgctgacactccatgcagagctcctcgctgcggcaggccaggatgttcttgcaggaggcccgggcgcacttgggccttgaggtgctttgtgtggttcgaggcacatctctgcgctggctcgatctcagttgctcttctgtccttttggcctcatgaaatctctgattctgagcttcaatgaaacacttctggcagtatccttcaaacatggtgcttccaagggtgccgcattccctccccaggcacggaatggtgttctggaacctggacgctgtgggactgactttccctgaggcagcagcaaaatgtttgttttctctgtactcgatgaaacacagtgtgcaaaagcccttgttttctggagtcccaaaatacacgcagccggcttttctgcacttgctcgtccccgtcctgtccccaggagtccgtgcagcttgagacaggcagccagcaggggcgtcgtttccagctctgtggcaagaatgcggggaggggctccggacgagccgcgagggatctgacttggaacgctggtgacaggaaggagggaggctggtgctgaggctggaggaggcctctgctgtagtccttttgaagcaagtactgcagatcccattaaatgtcctggtaacatcctggaggcaggcttggcacttcccgggatccaagtgccttgtgtggtctggggcgtggctggcgtgaagttgccgggcgttgtggcaacgttcacaaaatccgttgtgctgcacattcagtgtgaaggggcagccggggctcctgcacttcatggcagtggtctcactgaacagaaaagggctgggtgctgtcggtggggccgaatgaggccccccagtggactcctcagggttccacgccaagggctcataggcttctccccgagaggccccgagcgccatgccagggagcccctcagggcccggcttggagttcagctttgggagtttgttttgattcttttgccgcctctctgagcactcatggcataaaggctgggtgttcacagacatgaagaaggggcagttgggcgtttcacattttacatccatgagagaaagctggggcacggaaggttccatgggattctgggcgtgcccctctctcctcccctgctcgctgttttcctgccatttcttgtactcatgctgaacaagttcaaagtaatcatctaccagattgatttcttttggtaagttagcttcatccaactttgcggcattgatgagatgagttgtgccatggtcccagccttggacggggatttctatcaccattaagtactcttttaagagcttctccttcatctcattttcaggatctgtcaaaaagtgaacttttaagtcttcaaatcttccccggtctctgttaacaagtggaacagctcggatttcaggcccactgtccttcagggtcaccaagggtacaaaatgatggctgtcatagccgagaacaatggggtatctgtagcattcctgggcaggccagtggagaggcaagtaaattccacccactttcaaaggggcgaaattggaacctgattccaaacttcttagcattttgtctgaaatgacaatgattggccttctgaggatgttgcaaaggacaaatatgtgtatttcttccagtgagttgtactgaagtccacttcgggccatgggtgtgtctgtggaagccattttgataagattgtcccattcatcattccagttccgagtatcatagcaaagccccgtttcaacaaattcctgagatttgagagactccagttgccagcggaatttaaagttgcgtgtgtctgtttccttgagcgtgctgaacagcgccttcctcagtaccaagtctgtgtcctgaacgccccacatgtactgagaagtggcatgcatgaggcaattgccgtcaccgttcgttttcagcgccacaagcttccggacttctcgacaccagttgagtttcttctggctttccagggtggcctggatgtttctgtcgatgagggctttgtggatgatctcccgaaactgaggacaaaactggcaagttctgaacatttccagtgtgtatcggtgcatggttttaaaatgatgaatgatcccattagtaggtttaaaaatgtcttctggagttctctcccgtatcttcacagctttccgcatattgctcaaatacaaagcctgaggaaggacttgttcagccatggtggctttcccatttttgcttagcttttagcgatggctttcacgacacctaagacgacaaaaaccttctttaaactactgtcccgacgaccggagactcaggcacaaccccaacagccaagggcaaactccagggagcattagcaccggcgccctgcgggccctgcccggcctacacccagcgaacggggccgccccggcgcccagcccctcccccacccgggccgcgagtcccgggaagcggcgcgggcagcaccgcccggccctttgtgcgccgcccgccgtccgcgtcctccatcttgagaccgggagcggccatctttccgcgctcgcagcccgcccgggcggggcgctgggtctccgaccgcccgccccgccccgccgcggccgtctgccccgggaccgccgggcacggaggccaccttgggcggcctcggctgggccgccctggcagtaacacgcggctgccggccgaactcgagcgcgaagacagacggggcgggcgcgaaggcgcggatcgcacgcggcggccacggcgccccagcaggccgccaccgggcacgcggtagggaaccgcgagagcggagggcctcgagttctccacctccccccgcccgcagctcggaatcaggaccagggcgcagagccctctacgcgcggggggccgggaggcacgctaaggccgtggccaccggcggaggccatgcggacggaggccacacccgtactcacctgtgtcctggcggcaaacccgttgcgaaaaagaacgttcgcggggaccacggcgcttatatatggtcctcccccaccctcggggaaaagggcggagccagcacacgacaccactttcccagtttaccccgcgccacctccacccggcaccggttccaccgccgtcccctccccccatcttcggggaccgtgggcgatgtgcgttcagcccactgacgagcacacggcgcccggcgcatgctcctctcaaccaggaggatgacgactgctggtgggtgggaggcggggtcgagcgctcactcggttctaggtttagtgggagtttatcgacggtccctgggatttccctggctgaggagagtcctccttttgtatgaattactctccgcacagctggggggtggggcggcggggaggcgtccagaatcttccctgaaccggtcgtagcttaactgcaaagttggaccgagatgggagcccttacccggcagtaccccaccggtcctcagtcttgcggtctcgcaggttaaggactaacccctggagccgcttcctctgccggggcttctccaccgcccttgccgtccgcgccccttccggctggagagggaggcgtaaaaggccggggaaccgcggcggcaggggcctcggggcggtcttcagggccgagaatccgcgagtggctcagtttgctgaccaacagcctggcgaacaggctcctgcgctgacctcttggctttttccattcagttcttttatctaagttcgttctacacaccacgtggtactccagacgtccagtttttgagtttagaatagacttaagtactacagttttctttacttctaatcctaattttattacgtttaagaccctgagtgtgtgtctaccctcctattaacattttttttccagtgtatactcttggttgcaagcatgaaaaacctaaaaagaattttttgagttcagtgcttatacacgatctcaagtagagactaagatctacagcgccaggaagcttatccacccaatttactactccaacgtttgctgtgaaatcactgtttctcaaaaatggcctatcccatttgaataaacggcttcatcttttgtcgtcctatccattgtgactgcattttaggcataaatccagggcaagacaagatgaggcctttttggttggcaatcaggcagatattcaaaaatattcctgaagaaagaggaacctttattttaaatgagctaattactagatcgtctcttccacgtgtagagcactactgcaactttttgagccaatctatcaacaaatatttgagaacctactatgtggccagagctaagagtggctccgaagcatatgcaaaagaaatacttcctttgggggaagaaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttaactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgaataacttcgtataggatactttatacgaagttatctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaatgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgatgggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgttggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggaagcgtcgggccggagcggagccccgggcggctcgctgctgccccctagcgggagagggacgcaattacatccctgggggctttggggggggctgtccccgccaatattccgagcctgaccgttccttgtttcgctgaagagcgcccgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 47 - DNA, 23 bp, synthetic construct
  misc_feature 1..23: note = FOS_sg1
  source 1..23: mol_type = other DNA
ccttgtttcgctgaagagcgccc

SEQ ID NO: 48 - DNA, 23 bp, synthetic construct
  misc_feature 1..23: note = AAVS_sg3
  source 1..23: mol_type = other DNA
ccaatattccgagcctgaccgtt

SEQ ID NO: 49 - DNA, 1203 bp, Gallus gallus
  source 1..1203: mol_type = genomic DNA
cggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgag

SEQ ID NO: 50 - DNA, 1204 bp, Gallus gallus
  source 1..1204: mol_type = genomic DNA
ctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaatgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccg

SEQ ID NO: 51 - DNA, 1204 bp, Gallus gallus
  source 1..1204: mol_type = genomic DNA
cggggacagcccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccagcagcccagactgcccagagccacatccagcctggccttgaatgcctgcagggatggggcatccacagcctccttgggcaacctgttcagtgcgtcaccaccctctggggggaaaacttcctcctcatatccaacctaaacctcccctgtctcagtttaaagccattccctcctgtcctatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgag

SEQ ID NO: 52 - DNA, 1204 bp, Gallus gallus
  source 1..1204: mol_type = genomic DNA
cggggacagccccccccccaaagcccccagggatgtaattgcgtccctctcccgctagggggcagcagcgagccgcccggggctccgctccggcccgacgctccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccagcagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcctatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgag

SEQ ID NO: 53 - DNA, 1203 bp, Gallus gallus
  source 1..1203: mol_type = genomic DNA
ctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaatgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcgggggaagcgtcgggccggagcggagccccgggcggctcgctgctgccccctagcgggagagggacgcaattacatccctgggggctttgggggggggctgtccccg

SEQ ID NO: 54 - DNA, 1203 bp, Gallus gallus; identical to SEQ ID NO: 49
  source 1..1203: mol_type = genomic DNA

SEQ ID NO: 55 - DNA, 1204 bp, Gallus gallus; identical to SEQ ID NO: 51
  source 1..1204: mol_type = genomic DNA

SEQ ID NO: 56 - DNA, 1204 bp, Gallus gallus; identical to SEQ ID NO: 52
  source 1..1204: mol_type = genomic DNA

SEQ ID NO: 57 - DNA, 1204 bp, Gallus gallus; identical to SEQ ID NO: 50
  source 1..1204: mol_type = genomic DNA

SEQ ID NO: 58 - DNA, 1203 bp, Gallus gallus
  source 1..1203: mol_type = genomic DNA
ctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaatgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgatgggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgttggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggaagcgtcgggccggagcggagccccgggcggctcgctgctgccccctagcgggagagggacgcaattacatccctgggggctttggggggggctgtccccg

SEQ ID NO: 59-61 - skipped (3 entries)

SEQ ID NO: 62 - DNA, 1500 bp, synthetic construct
  misc_feature 1..1500: note = B2M/HLA-E
  source 1..1500: mol_type = other DNA
atgtctcgctccgtggccttagctgtgctcgcgctactctctctttctggcctcgaggctgttatggctccgcggactttaattttaggttgcggcgcttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttg

SEQ ID NO: 63 - DNA, 867 bp, Homo sapiens
  source 1..867: mol_type = genomic DNA
tcacatggcataaagccctacagcaactgtcgccaccagaaagctgagtgtaaggacccatcggagaagcggagcctgggagcgggtgttgagtgggggcttccctctgggagtctccacgggggcagaatcttgcactttgttgctggcccgctggcgaagccctggtgcccgtgaggggctctggtccttggtgtcatgggtcagcagctcctgcaactcctcaaagagctggatgttgagcaggaacgcagtcttggcctcttctatcaccctctgcctgactgcgggagtcatctccagggagttcatgcgggagcggtagagctgcttgaacttggtggcactggcaatgttggggaaggtgaagaaggccaggccctcgccagagctgggcaggtccagggctttctgggcaatctttttgagcacctggcccccagacaggtcacccaggtagcgggtgtaggcgtgggccaccagcagctcgggctctgtgcgccccacctcgtggagccgcttcacatagcgctgcatggctggtgtgtaggggatgacctcctgccagcggggcccgtaccagaaggccaggtcctgctccagggcagccttgcggtgcagctcttctgggaagtagacaggggcgaagactgggctctccttgttgcgctcaatctcctcctccagggccacatagatgtggtacagggaggccatcaccagcttgaagccgtctcgggtcacctggcccttctgaaagttcctcatgaactcagcattctctgcctgggtgtgcacctccttggtggcctccttcagggcctctgacaaatcctggggcatgctgtcgggttgcggacgctccat

SEQ ID NO: 64 - DNA, 2370 bp, Homo sapiens
  source 1..2370: mol_type = genomic DNA
gccatacatctgcttgaactgaaagcattcgttgcagtagccgttgcacttggcattgccaaaatgatcacaggcgggggcccggcaacgctgcttgggggggtcttcgggggcaggctcaccccggtgggccccagggcccatcctctggttgggatgctgacactccatgcagagctcctcgctgcggcaggccaggatgttcttgcaggaggcccgggcgcacttgggccttgaggtgctttgtgtggttcgaggcacatctctgcgctggctcgatctcagttgctcttctgtccttttggcctcatgaaatctctgattctgagcttcaatgaaacacttctggcagtatccttcaaacatggtgcttccaagggtgccgcattccctccccaggcacggaatggtgttctggaacctggacgctgtgggactgactttccctgaggcagcagcaaaatgtttgttttctctgtactcgatgaaacacagtgtgcaaaagcccttgttttctggagtcccaaaatacacgcagccggcttttctgcacttgctcgtccccgtcctgtccccaggagtccgtgcagcttgagacaggcagccagcaggggcgtcgtttccagctctgtggcaagaatgcggggaggggctccggacgagccgcgagggatctgacttggaacgctggtgacaggaaggagggaggctggtgctgaggctggaggaggcctctgctgtagtccttttgaagcaagtactgcagatcccattaaatgtcctggtaacatcctggaggcaggcttggcacttcccgggatccaagtgccttgtgtggtctggggcgtggctggcgtgaagttgccgggcgttgtggcaacgttcacaaaatccgttgtgctgcacattcagtgtgaaggggcagccggggctcctgcacttcatggcagtggtctcactgaacagaaaagggctgggtgctgtcggtggggccgaatgaggccccccagtggactcctcagggttccacgccaagggctcataggcttctccccgagaggccccgagcgccatgccagggagcccctcagggcccggcttggagttcagctttgggagtttgttttgattcttttgccgcctctctgagcactcatggcataaaggctgggtgttcacagacatgaagaaggggcagttgggcgtttcacattttacatccatgagagaaagctggggcacggaaggttccatgggattctgggcgtgcccctctctcctcccctgctcgctgttttcctgccatttcttgtactcatgctgaacaagttcaaagtaatcatctaccagattgatttcttttggtaagttagcttcatccaactttgcggcattgatgagatgagttgtgccatggtcccagccttggacggggatttctatcaccattaagtactcttttaagagcttctccttcatctcattttcaggatctgtcaaaaagtgaacttttaagtcttcaaatcttccccggtctctgttaacaagtggaacagctcggatttcaggcccactgtccttcagggtcaccaagggtacaaaatgatggctgtcatagccgagaacaatggggtatctgtagcattcctgggcaggccagtggagaggcaagtaaattccacccactttcaaaggggcgaaattggaacctgattccaaacttcttagcattttgtctgaaatgacaatgattggccttctgaggatgttgcaaaggacaaatatgtgtatttcttccagtgagttgtactgaagtccacttcgggccatgggtgtgtctgtggaagccattttgataagattgtcccattcatcattccagttccgagtatcatagcaaagccccgtttcaacaaattcctgagatttgagagactccagttgccagcggaatttaaagttgcgtgtgtctgtttccttgagcgtgctgaacagcgccttcctcagtaccaagtctgtgtcctgaacgccccacatgtactgagaagtggcatgcatgaggcaattgccgtcaccgttcgttttcagcgccacaagcttccggacttctcgacaccagttgagtttcttctggctttccagggtggcctggatgtttctgtcgatgagggctttgtggatgatctcccgaaactgaggacaaaactggcaagttctgaacatttccagtgtgtatcggtgcatggttttaaaatgatgaatgatcccattagtaggtttaaaaatgtcttctggagttctctcccgtatcttcacagctttccgcatattgctcaaatacaaagcctgaggaaggacttgttcagccat

SEQ ID NO: 65 - DNA, 2367 bp, Homo sapiens
  source 1..2367: mol_type = genomic DNA
gctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggc

SEQ ID NO: 66 - DNA, 1500 bp, synthetic construct
  misc_feature 1..1500: note = B2M/HLA-E
  source 1..1500: mol_type = other DNA
caagctgtgagactcagacccctgggcactgtcgctccactcagccttagagtagctccctccttttccacctgagctcttcttcctccatatcacagcagcaaccacagctccagagaccacagatccaaggagaaccaggccagcaatgatgcccacgatggggatggtgggctgggaagccggcttccatctcagggtgacgggctcgggtagcccctcatgctgcacatggcacgtgtatctctgctcctctccagaaggcaccaccacagctgcccacttctggaaggttccatcccctgcaggcctggtctccacgagctccgtgtcctgggtatggccctccccatcctgctgccaggtcagtgtgatctccgcagggtagaagcccagggcccagcacctcagggtggcctcatggtcagagatggggtggtgagtcacgtgtgtctttgggggctccaggtgaagcagcgtctccttccccttctccaggtatttgtggagccactccacgcatgtgtcttccaggtaggctctctggtgctccgcctcagaggcatcatttgacttttgctcggagatctgagccgccgtgtccaccgcggtccaggagcgcaggtcctcattcagggtgagataatccttgccgtcgtaggcgaactgttcatacccgcggaggaagcgcccgtcgggccccagctcgcagccatgcatccactgcagggtgtgagacccggcctcgctctgattgtagcagccgcgcagcgtccgcagattcactcggaaaatctgtgcggtgtccctggcgctccgtgtctcccggtcccaatactctgacccctcctgctccatccacggcgcccgcggcaccatcctcggactcgcggcgtcgttgtcgaagcgcacgaactgggtgtcgtccacgtagcccacagagatgaagcggggctccccgcggccgggccgggacacggaagtgtggaaatacttcaaggagtgagatccggaaccgccaccaccgcttcctccgccgccactaccgccaccaccagaaccgccaccacccatgtcgcgatcccacttaactatcttgggctgtgacaaagtcacatggttcacacggcaggcatactcatctttttcagtgggggtgaattcagtgtagtacaagagatagaaagaccagtccttgctgaaagacaagtctgaatgctccactttttcaattctctctccattcttcagtaagtcaacttcaatgtcggatggatgaaacccagacacatagcaattcaggaaatttgactttccattctctgctggatgacgtgagtaaacctgaatctttggcgtacgctggatggagccgccaccaccagaaccgccaccaccggaaccgccgcaacccaggaagagggttcggggcgccatgacagcctcgaggccagaaagagagagtagcgcgagcacagctaaggccacggagcgagacat

SEQ ID NO: 67 - DNA, 1530 bp, Homo sapiens
  source 1..1530: mol_type = genomic DNA
atggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggta

SEQ ID NO: 68 - DNA, 1533 bp, Homo sapiens
  source 1..1533: mol_type = genomic DNA
ctataccatatctttccagaaatatgaaggcttgtgaaagataagcaagcctatgatggccactgtgaaaaggaccagggagaatagaaccatgaggaagacataggtggagtgggagagaggtgtggacaatggttgctcagctgggatcatgttggtcaggttcagcatgtagcccaaagtccagccggcgtcgctgccctggatcttgccaatgaaatggatgtgctcccaggaatcagctgtgaaatgatagccttgcagaaggagggagagaatgtaggtaccagaaaagcagtattcactcaggtacttctcctttactccagcgtaagatgtttttatctcctcccaaggctgagcacagaactttttcatcatctcagtcaccttttcctgagagactttctctgatgtcaagtttaaaaacttcatcacaaagtaaaaagctgaaaatgccccaaaatccccctggagtggtggcaagaaaatcccattgaaggcacactgggagtaagggcagtaactggtgttgaagagctccaggatgctttgatggcattgttgatagtttccaataccctggatttcaaactgctggaatggaagagtcatctcaaatctcttggtgcagggggtcttgtaaaggtcacttacgttcactaccttcttatatccaggatgaaagcatgggtccctgagaatttcattacttgcaacctgaatgtccttggccagtttctgccagagtgcctgatccttcccatagcacaagaagctatgtgtgtagacattgtagtccttgccatagaggcgaaattgcagagcattatctggggactcgatagtctggttttggggtacaaaagtgacttgtgtagaggctcccccaaggtccaaagctccaaaggtttcctgattattggtttcatatgggactatgctgaaccaccttgttttctgactgaatttgcccagcagatagttgatagtaatccagccataggcaccttcctcttggccagtaatgatcctggcaccctggaagtcaaaggggtagttgctgaggctcctctccaccacatccagaaccctgtctgccaactcttcactttccatcctgagcaaccgcatgcctgccgtggctcccaggtaaacgggtgtctcttggtgctgggaccttggaatcacttccctagctctttccatgcaatcagtcaggtaaatgcctatttcatttactttctgaacaaattttgagattccaggacctttaaccctgcattcttctacttgatgcaccacgcctgtgtcattctccttttctgctggccacttatagatgtataaacttgtgtgagaagaacccgcatccagcacaatcccatacttaacgttttctggcaatgctttgttctgggtcaaccccacagcaagcaaagctatcacagctatgatagaggagaagccaaggatggctaggatattcttggagcaaaatgtcttcacgttagactcctttgtatcttccat

SEQ ID NO: 69 - DNA, 1530 bp, Homo sapiens
  source 1..1530: mol_type = genomic DNA
taccatatctttccagaaatatgaaggcttgtgaaagataagcaagcctatgatggccactgtgaaaaggaccagggagaatagaaccatgaggaagacataggtggagtgggagagaggtgtggacaatggttgctcagctgggatcatgttggtcaggttcagcatgtagcccaaagtccagccggcgtcgctgccctggatcttgccaatgaaatggatgtgctcccaggaatcagctgtgaaatgatagccttgcagaaggagggagagaatgtaggtaccagaaaagcagtattcactcaggtacttctcctttactccagcgtaagatgtttttatctcctcccaaggctgagcacagaactttttcatcatctcagtcaccttttcctgagagactttctctgatgtcaagtttaaaaacttcatcacaaagtaaaaagctgaaaatgccccaaaatccccctggagtggtggcaagaaaatcccattgaaggcacactgggagtaagggcagtaactggtgttgaagagctccaggatgctttgatggcattgttgatagtttccaataccctggatttcaaactgctggaatggaagagtcatctcaaatctcttggtgcagggggtcttgtaaaggtcacttacgttcactaccttcttatatccaggatgaaagcatgggtccctgagaatttcattacttgcaacctgaatgtccttggccagtttctgccagagtgcctgatccttcccatagcacaagaagctatgtgtgtagacattgtagtccttgccatagaggcgaaattgcagagcattatctggggactcgatagtctggttttggggtacaaaagtgacttgtgtagaggctcccccaaggtccaaagctccaaaggtttcctgattattggtttcatatgggactatgctgaaccaccttgttttctgactgaatttgcccagcagatagttgatagtaatccagccataggcaccttcctcttggccagtaatgatcctggcaccctggaagtcaaaggggtagttgctgaggctcctctccaccacatccagaaccctgtctgccaactcttcactttccatcctgagcaaccgcatgcctgccgtggctcccaggtaaacgggtgtctcttggtgctgggaccttggaatcacttccctagctctttccatgcaatcagtcaggtaaatgcctatttcatttactttctgaacaaattttgagattccaggacctttaaccctgcattcttctacttgatgcaccacgcctgtgtcattctccttttctgctggccacttatagatgtataaacttgtgtgagaagaacccgcatccagcacaatcccatacttaacgttttctggcaatgctttgttctgggtcaaccccacagcaagcaaagctatcacagctatgatagaggagaagccaaggatggctaggatattcttggagcaaaatgtcttcacgttagactcctttgtatcttccat

SEQ ID NO: 70 - DNA, 1527 bp, Homo sapiens
  source 1..1527: mol_type = genomic DNA
taccatatctttccagaaatatgaaggcttgtgaaagataagcaagcctatgatggccactgtgaaaaggaccagggagaatagaaccatgaggaagacataggtggagtgggagagaggtgtggacaatggttgctcagctgggatcatgttggtcaggttcagcatgtagcccaaagtccagccggcgtcgctgccctggatcttgccaatgaaatggatgtgctcccaggaatcagctgtgaaatgatagccttgcagaaggagggagagaatgtaggtaccagaaaagcagtattcactcaggtacttctcctttactccagcgtaagatgtttttatctcctcccaaggctgagcacagaactttttcatcatctcagtcaccttttcctgagagactttctctgatgtcaagtttaaaaacttcatcacaaagtaaaaagctgaaaatgccccaaaatccccctggagtggtggcaagaaaatcccattgaaggcacactgggagtaagggcagtaactggtgttgaagagctccaggatgctttgatggcattgttgatagtttccaataccctggatttcaaactgctggaatggaagagtcatctcaaatctcttggtgcagggggtcttgtaaaggtcacttacgttcactaccttcttatatccaggatgaaagcatgggtccctgagaatttcattacttgcaacctgaatgtccttggccagtttctgccagagtgcctgatccttcccatagcacaagaagctatgtgtgtagacattgtagtccttgccatagaggcgaaattgcagagcattatctggggactcgatagtctggttttggggtacaaaagtgacttgtgtagaggctcccccaaggtccaaagctccaaaggtttcctgattattggtttcatatgggactatgctgaaccaccttgttttctgactgaatttgcccagcagatagttgatagtaatccagccataggcaccttcctcttggccagtaatgatcctggcaccctggaagtcaaaggggtagttgctgaggctcctctccaccacatccagaaccctgtctgccaactcttcactttccatcctgagcaaccgcatgcctgccgtggctcccaggtaaacgggtgtctcttggtgctgggaccttggaatcacttccctagctctttccatgcaatcagtcaggtaaatgcctatttcatttactttctgaacaaattttgagattccaggacctttaaccctgcattcttctacttgatgcaccacgcctgtgtcattctccttttctgctggccacttatagatgtataaacttgtgtgagaagaacccgcatccagcacaatcccatacttaacgttttctggcaatgctttgttctgggtcaaccccacagcaagcaaagctatcacagctatgatagaggagaagccaaggatggctaggatattcttggagcaaaatgtcttcacgttagactcctttgtatcttc

SEQ ID NO: 71 - DNA, 1173 bp, synthetic construct
  misc_feature 1..1173: note = CD46_LL
  source 1..1173: mol_type = other DNA
gagagaagtaaattttacttctctgtgggtctcatcagttaggtatgtgcctttcttcttcctcctttgaagatatctgtacgggacaacacaaattactgcaactccaacaactatggcaataacaatcacagcaatgacccaaacatccaaactgtcaagtattccttcctcaggtttaggatatcctggataatttgagactggaggcttgtaagtaggcctaggacctgaggcactggacgctggagattttgtagtggaagaagtcgacactgaatgactcaaagctggaggttttgtactagatggaggcagcactttaagacactttggaactgggggatcccaagtactgttactgtcacagacaattgtgtcgctgccatcgaggtaaaaacccttatcgcattcaaacataactgttgctttgtagtaaaatttttttccaaatcctgatatctgttttccattttcgactactggaaatcgacatttgaccactttacactctggagcagcacgactccacactgaattgtcaccacaataaatcgtgctctctccaataagtgaaaatggatctggtccaggtgcaggatcacaactataagttactgcatcaagatactcaaatacttctacttcactaaaggtgtgttttccattcttgatctttggaggtggtgtacacaagaccttctcacatattgggggcttaccgctccaaattgctactgatcctttaagttcacaatacaggatctcctcaccaatcaggtagtaaccctcgttgcagatgaagtgcatctgataaccaaactcgtaagtcccatttgcagggactgcttggccatttaaaggatcccgtatatatggacatgtttctctataacaggcgtcatctgagacaggtagccatgtatgattccgatcacaaatagtatgggtggcaagaggaggtatatagaagtatccttttttacacttataatctactcgttcaccaatctcatagtagggttttggtttaccaatgagctccatagcttcaaatgttggtggctcctcacaggcatcggagaaggagtacagcagcaacaccatggccgccagaagcaacccaggaaagcgccaggaaggaaagggacactcgcggcggccgggaggctc

SEQ ID NO: 72 - DNA, 1131 bp, synthetic construct
  misc_feature 1..1131: note = CD46BC1da
  source 1..1131: mol_type = other DNA
atggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctc

SEQ ID NO: 73 - DNA, 1152 bp, synthetic construct
  misc_feature 1..1152: note = CD46BC2da
  source 1..1152: mol_type = other DNA
atggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggc

SEQ ID NO: 74 - DNA, 1176 bp, synthetic construct
  misc_feature 1..1176: note = CD46i
  source 1..1176: mol_type = other DNA
atggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcacttcatctgcaacgagggttactacctgattggtgaggagatcctgtattgtgaacttaaaggatcagtagcaatttggagcggtaagcccccaatatgtgagaaggtcttgtgtacaccacctccaaagatcaagaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctc

SEQ ID NO: 75 - DNA, 1173 bp, synthetic construct
  misc_feature 1..1173: note = CD46i
  source 1..1173: mol_type = other DNA
gagagaagtaaattttacttctctgtgggtctcatcagttaggtatgtgcctttcttcttcctcctttgaagatatcggtacgggacaacacaaattactgcaactccaacaactatggcaataacaatcacagcaatgacccaaacatccaaactgtcaagtattccttcctcaggtttaggatatcctggataatttgagactggaggcttgtaagtaggcctaggacctgaggcactggacgctggagattttgtagtggaagaagtcgacactgaatgactcaaagctggaggttttgtactagatggaggcagcactttaagacactttggaactgggggatcccaagtactgttactgtcacagacaattgtgtcgctgccatcgaggtaaaaacccttatcgcattcaaacataactgttgctttgtagtaaaatttttttccaaatcctgatatctgttttccattttcgactactggaaatcgacatttgaccactttacactctggagcagcacgactccacactgaattgtcaccacaataaatcgtgctctctccaataagtgaaaatggatctggtccaggtgcaggatcacaactataagttactgcatcaagatactcaaatacttctacttcactaaaggtgtgttttccattcttgatctttggaggtggtgtacacaagaccttctcacatattgggggcttaccgctccaaattgctactgatcctttaagttcacaatacaggatctcctcaccaatcaggtagtaaccctcgttgcagatgaagtgcatctgataaccaaactcgtaagtcccatttgcagggactgcttggccatttaaaggatcccgtatatatggacatgtttctctataacaggcgtcatctgagacaggtagccatgtatgattccgatcacaaatagtatgggtggcaagaggaggtatatagaagtatccttttttacacttataatctactcgttcaccaatctcatagtagggttttggtttgccgatgagctccatagcttcaaatgttggtggctcctcacaggcatcggagaaggagtacagcagcaacaccatggccgccagaagcaacccaggaaagcgccaggaaggaaagggacactcgcggcggccgggaggctc

SEQ ID NO: 76 - DNA, 1173 bp, Homo sapiens
  source 1..1173: mol_type = genomic DNA
gagagaagtaaattttacttctctgtgggtctcatcagttaggtatgtgcctttcttcttcctcctttgaagatatctgtacgggacaacacaaattactgcaactccaacaactatggcaataacaatcacagcaatgacccaaacatccaaactgtcaagtattccttcctcaggtttaggatatcctggataatttgagactggaggcttgtaagtaggcctaggacctgaggcactggacgctggagattttgtagtggaagaagtcgacactgaatgactcaaagctggaggttttgtactagatggaggcagcactttaagacactttggaactgggggatcccaagtactgttactgtcacagacaattgtgtcgctgccatcgaggtaaaaacccttatcgcattcaaacataactgttgctttgtagtaaaatttttttccaaatcctgatatctgttttccattttcgactactggaaatcgacatttgaccactttacactctggagcagcacgactccacactgaattgtcaccacaataaatcgtgctctctccaataagtgaaaatggatctggtccaggtgcaggatcacaactataagttactgcatcaagatactcaaatacttctacttcactaaaggtgtgttttccattttttatttttggaggtggtgtacacaaaaccttttcacatattgggggcttaccgctccaaattgctactgatcctttaagttcacaatatagaatttcttcaccaattaagtaataaccctcattacaaataaagtgcatctgataaccaaactcgtaagtcccatttgcagggactgcttggccatttaaaggatcccgtatatatggacatgtttctctataacaggcgtcatctgagacaggtagccatgtatgattccgatcacaaatagtatgggtggcaagaggaggtatatagaagtatccttttttacacttataatctactcgttcaccaatctcatagtagggttttggtttaccaatgagctccatagcttcaaatgttggtggctcctcacaggcatcggagaaggagtacagcagcaacaccatggccgccagaagcaacccaggaaagcgccaggaaggaaagggacactcgcggcggccgggaggctc

SEQ ID NO: 77 - DNA, 969 bp, Homo sapiens
  source 1..969: mol_type = genomic DNA
atgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaa

SEQ ID NO: 78 - DNA, 915 bp, Homo sapiens
  source 1..915: mol_type = genomic DNA
atgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataac

SEQ ID NO: 79 - DNA, 975 bp, Homo sapiens
  source 1..975: mol_type = genomic DNA
atgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataataa

SEQ ID NO: 80 - DNA, 918 bp, Homo sapiens
  source 1..918: mol_type = genomic DNA
atgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactga

SEQ ID NO: 81 - DNA, 915 bp, Homo sapiens; identical to SEQ ID NO: 78
  source 1..915: mol_type = genomic DNA

SEQ ID NO: 82 - DNA, 969 bp, Homo sapiens; identical to SEQ ID NO: 77
  source 1..969: mol_type = genomic DNA

SEQ ID NO: 83 - DNA, 918 bp, Homo sapiens
  source 1..918: mol_type = genomic DNA
tcagttattcctaggaggttgtatagtcttctgattggaagccacaaatttcatataaactagtccaagtaattgtgctagagctaagatactcaaacctgaaatcagaagagggccatgcattggtatacacgccgcaatacagagactcagtccaaccacagcgaggatataggctatcacctgaataaccaatatggcaatgacgaaggaggttaatccaatcgctgtactaaacacatagtagtgaagtaatattaatatccctgtagaagtcacaattaaaccaaggccagtagcattctttaatgaatattcacctgggacgaaaagaatggctccaacaatgacaatgacagtgatcactagtccagcaacaagtaaagcaattgttttctcatccataccaccggatctatatttaagtgttttaataccaaactgtccccagaacaggagtatagcaaaaattgggaaaataacaataagaatattttcatttggagaaaaccatgaaacaacacgatattttagctcgatgatcgtttcaccttctctggttaattctgttacttcacaagtgtagtttcctgtgtgtgagacagcatcactcttatccatcttcaaagaggcatctccttttagtaattgtgagacttcaatttttgcactactaaagtcagtggggacagtggacttgtttagagctccatcaaaggtgtaaatatctcttcctttaaatttccactttacgtatacttcagtagtgttttgtgcctccatattagtaacaaagcatggaatgacgacagtgtcattacaaaacgtgaattctacagattttgttttattaaatagtagctgagctgatccgcagcacgccgagcccagcaacagcgccgctaccaggggccacat

SEQ ID NO: 84 - DNA, 1143 bp, Homo sapiens
  source 1..1143: mol_type = genomic DNA
atgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgact

SEQ ID NO: 85 - DNA, 1146 bp, Homo sapiens
  source 1..1146: mol_type = genomic DNA
atgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttaa

SEQ ID NO: 86 - DNA, 384 bp, Homo sapiens
  source 1..384: mol_type = genomic DNA
gggatgaaggctccaggctgctgccagaaatggagtcaccagcagaagaactgttttctctgataaggatgtcccaccattttcaagctgttcgttaaagttacacaggtccttcttgcagcagtagtacgttagctcattttccctcaagcgggttgtgacgtcgttgaaattgcaatgctcaaacttccaacacttgttatacacttgtaacccagctttggtaatgagacacgcatcaaaatcagatgaacaattgacggctgttttgcagtcagcagttgggttaggacagttgtagcactgcaggctatgacctgaatggcagaagacagccaggacgagcagcagcccgaacaggacagaccctccttggattcccat

SEQ ID NO: 87 - DNA, 669 bp, Homo sapiens
  source 1..669: mol_type = genomic DNA
attgatgggaataaaataaggctgaaattgcttttcacattctggctctgttgggggcattttcacatagacccctgttgtaagagggcttcttttctttagcattttgctcaaagaaacagctgtgaggagaaagctataaaaaaacaaccccgaactaactgctgcaaggatccagaggaggaagtcagaatctgggcacggttctggatcaattacataaatctgggttccgttgcctatgcccaggtagtatggcggtgggtacatgagctccaccttgcagatgtagagtcccgtgtccatggccctcagtccttggatagtgaggttcacttgatttccactggaggtgcccgtgcagatggaatcatctaggaaggtcaactcattccccatcatgtaggttgccgcacagacttcagtcacctggctgtcagcctgccgaagcactgtcacccggacctcagtggctttgcctggagatgcatactcacacacaaagctggcgatgcctcggctgctggccagtaccacagcaggctgggccacgtgcattgctttgcagaagacagggatgaagagaagaaaaaacaggagagtgcagggccaggtcctggtagccaggttcagctgagccttgtgccgctgaaatccaaggcaagccat

SEQ ID NO: 88 - DNA, 672 bp, Homo sapiens
  source 1..672: mol_type = genomic DNA
ttaattgatgggaataaaataaggctgaaattgcttttcacattctggctctgttgggggcattttcacatagacccctgttgtaagagggcttcttttctttagcattttgctcaaagaaacagctgtgaggagaaagctataaaaaaacaaccccgaactaactgctgcaaggatccagaggaggaagtcagaatctgggcacggttctggatcaattacataaatctgggttccgttgcctatgcccaggtagtatggcggtgggtacatgagctccaccttgcagatgtagagtcccgtgtccatggccctcagtccttggatagtgaggttcacttgatttccactggaggtgcccgtgcagatggaatcatctaggaaggtcaactcattccccatcatgtaggttgccgcacagacttcagtcacctggctgtcagcctgccgaagcactgtcacccggacctcagtggctttgcctggagatgcatactcacacacaaagctggcgatgcctcggctgctggccagtaccacagcaggctgggccacgtgcattgctttgcagaagacagggatgaagagaagaaaaaacaggagagtgcagggccaggtcctggtagccaggttcagctgagccttgtgccgctgaaatccaaggcaagccat

SEQ ID NO: 89 - DNA, 873 bp, Homo sapiens
  source 1..873: mol_type = genomic DNA
atgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaa

SEQ ID NO: 90 - DNA, 870 bp, Homo sapiens
  source 1..870: mol_type = genomic DNA
atgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacg

SEQ ID NO: 91 - DNA, 873 bp, Homo sapiens
  source 1..873: mol_type = genomic DNA
ttacgtctcctccaaatgtgtatcactttgcttctttgagtttgtatcttggatgccacattttttcacatccatcattctcccttttcttaaacggaagatgaatgtcagtgctacaccaaggcataataagatggctcccagaattaccaagtgagtcctttcatttggaggatgtgccagaggtagttctgggatgaccaattcagctgtatggttttcctcaggatctaatctcctaaaagtgcagtagaaaatctcattagttgttgtgttgattctcagtgtgctggtcacattgaaaagcttctcctctctcttggaattggtggtggtggtcttaccactcaggacttgatggtcactgcttgtccagatgacttcggccttggggtagccctcagcctgacatgtcagttcatgttcagaggtgactggatccacaaccaaaattctttggttgattttgttgtatggggcattgactttcacagtaattcgcttgtagtcggcaccaccatagctgatcatgcagcggtacacccctgcatcctgcaatttcacatctgtgatctgaagtgcagcatttcccagggagagctggtccttcaacagccgggccctctgtctgtagctactatgctgaaccttcaggtcttcctctccatgcacaaattgaataatgttcttatcctccatttcccaatagacaattagtgcagccaggtctaattgtttttctactgggaatttgcattcaattgtcatattgctaccatactctaccacatataggtccttgggaaccgtgacagtaaatgcgttcagcaaatgccagtaggtcatgaatataaagacagcaaatatcctcat

SEQ ID NO: 92 - DNA, 714 bp, Homo sapiens
  source 1..714: mol_type = genomic DNA
acatcgccgtccacctgtgcacaggaagatgcctacagccacaccagcaatgatgaaactgcccaccaggacgcccaggaccagcgaagtgtaggagcggcttgtttggctccctttcgtgttttccgcggaaatatgtttctgcacatactgcacacaggtgtcctccaggaattcccgcagttcataccgagtgcggttgtaggcattgagctgctgcagggtgaaggtgaccactccggaggtgacctgggtgtctgcctgccacaaggctctctccggccggaaactcacaaaggagctcccattcacagccacttcgaagaagacatgggctctagagccctcgggaggcagctcacagcccaggaagcagcggatggtcagaggaaaggccaaggtccgctcctggtgcaccaggcgcacgaggccgtggaactggagcaggtaggactgcaggccactctgcgtgcgcgcccagctctcgggctcctgcaagggctgcagctgaatgatcgtggtgttggtgtctgggccttccagcacgtgcgttaggtgtccccccagcgacgcgttgccctggtaccacacgtgataggggtcgcggaagtaggagatctggagcatatgaagtctttggaggccatctgaggcgtcttggctacaaaaggcccagccagacagcagcagtatcggcagcaatgttgtcaacat

SEQ ID NO: 93 - DNA, 714 bp, Homo sapiens
  source 1..714: mol_type = genomic DNA
atgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgt

SEQ ID NO: 94 - DNA, 1788 bp, synthetic construct
  misc_feature 1..1788: note = hsTFPI/CD4TM
  source 1..1788: mol_type = other DNA
acgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcat

SEQ ID NO: 95 - DNA, 1884 bp, synthetic construct
  misc_feature 1..1884: note = hsTFPI/CD4TM/P-selectin
  source 1..1884: mol_type = other DNA
atgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgggaggcggaggatctggcggcggaggaagtggcggaggcggaagcggtggtggtggatctgggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagcgtttcagacaaaaagatgatgggaaatgccccttgaatcctcacagccacctaggaacatatggagtttttacaaacgctgcatttgacccgagtcct

SEQ ID NO: 96 - DNA, 1881 bp, synthetic construct
  misc_feature 1..1881: note = hsTFPI/CD4TM/P-selectin CT
  source 1..1881: mol_type = other DNA
aggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaat

SEQ ID NO: 97 - DNA, 1725 bp, Homo sapiens
  source 1..1725: mol_type = genomic DNA
atgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactc

SEQ ID NO: 98 - DNA, 1725 bp, Homo sapiens
  source 1..1725: mol_type = genomic DNA
gagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagctgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaaccccaggccggccagggccagcgcgccaaggaccaggaccccaagcat

SEQ ID NO: 99 - DNA, 1722 bp, synthetic construct
  misc_feature 1..1722: note = thrombomodulin precursor (THBD)
  source 1..1722: mol_type = other DNA
atgcttggggtcctggtccttggcgcgctggccctggccggcctgggattccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcaactgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagaga

SEQ ID NO: 100 - DNA, 1725 bp, synthetic construct
  misc_feature 1..1725: note = thrombomodulin precursor (THBD)
  source 1..1725: mol_type = other DNA
atgcttggggtcctggtccttggcgcgctggccctggccggcctgggattccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcaactgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactc

SEQ ID NO: 101 - DNA, 1725 bp, synthetic construct
  misc_feature 1..1725: note = thrombomodulin precursor (THBD)
  source 1..1725: mol_type = other DNA
gagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcat

SEQ ID NO: 102 - DNA, 1728 bp, synthetic construct
  misc_feature 1..1728: note = thrombomodulin precursor (THBD)
  source 1..1728: mol_type = other DNA
tcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcat

SEQ ID NO: 103 - DNA, 1881 bp, synthetic construct; identical to SEQ ID NO: 96
  misc_feature 1..1881: note = TPFI/CD4TM/P-selectin
  source 1..1881: mol_type = other DNA

SEQ ID NO: 104 - DNA, 2370 bp, synthetic construct
  misc_feature 1..2370: note = A20
  source 1..2370: mol_type = other DNA
atggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggc

SEQ ID NO: 105 - DNA, 1500 bp, synthetic construct
  misc_feature 1..1500: note = B2M/HLA-E
  source 1..1500: mol_type = other DNA
atgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttg

SEQ ID NO: 106 - DNA, 1533 bp, Homo sapiens
  source 1..1533: mol_type = genomic DNA
atggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatag

SEQ ID NO: 107 - DNA, 1143 bp, Homo sapiens
  source 1..1143: mol_type = genomic DNA
agtcagcaagcccatggttactagcgtcccaagcaaacctgtcaacgtgaaacacgtgtgcccagatagaagacgggtagtacctgaagtggttccacttcctttatttggggttgtttcatgaaaatgcttggttgtcctggaaacaggtgtactccgtgttgcttgagcatttggtgtggtggtttttgtggtggttttctgagaagttggtgagacttctgtagttggaacatttactgtggtaggtttctgaactgttggtgggaccttggaagttagagattttcctctgcattcaggtggtgggccactccactctccttcatcattattcacagtacaataaatagagtgctctccaatcatggtgaatcctttattacatgcatacgttacagactgtctatatccataatggtcacgttccccttgaattattccattgtcaatttgtggtggtgctggacaataaatttctctgcactctggcaacgggtcactccactggacagagctgcctgaaataagacaaaaactagaagtcgagccaaataatttgtaccctgtgttacatgagaaggagatggttgcaccaaataatatgccacctggtacatcaatctgaccatttcgtatttctcccggattagggcatgatttctttttacaaaattcgactgctgtggaccattttaaattctgaaggcaagttagttttggtgatagagaaggttctcttctgtaacctggacggcactcatattccacaacagtaccgactggaaaataattctgagtgatataaggctgtttgagggatgcagaatttagccttgttggcacctcgcagctacgattgcagaactcttcaatatctgaccattgactgcccttaaggcagatcactgagtccttctcgccaggaattttcacaaagctttcttcacatttgtacgttattacagtatcctcgggaaaacttgtacggccttccaaagctggctgggcattaggtacatctgggggaaggccacagtcaccccacacggccggcaggcacaacagcaccagcagcagcagccggggcagctccccgaggaggggcagcgccgcgggcacgctcggccgcgcgacggtcat

SEQ ID NO: 108 - DNA, 384 bp, Homo sapiens
  source 1..384: mol_type = genomic DNA
atgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccc

SEQ ID NO: 109 - DNA, 864 bp, Homo sapiens
  source 1..864: mol_type = genomic DNA
atggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatg

SEQ ID NO: 110 - DNA, 1491 bp, Homo sapiens
  source 1..1491: mol_type = genomic DNA
agacataaaaattttttgcttgaaagtaatgactgtgtagcacatgggacacttgtcaactgcttcagcacattgtttacaagtgactagatgtccacaaggaacaaaaacgatagcaatatttctatccatacagattttgcaaagcttctcctcttgcaggcgccttagctgctcttcagtactaatctctttctgtaatgaagtctgacttgactcatcttgcatactgtctttctgagcattcactagatctgcaaccagaacctcaagtgatttatagttgctcccagatatctgaattttttcctccattattttcttaatgtccttgaaactgaaccccattcgtatagcttcttgtaccataggattttggaagatggtatcatcaattcttctagttagtgatggtgttttctcagtagttcttaccagacactcctcaagtgaatgagttaaatgaatattgtttatatattcttgtcccttctgttctaacagatatttgcaccctggataccatttagcatgttgttcccaagggtcttcactgggcttccaatcagttagccctcctccacagtgaaagcactttactttatcaccttcacctaaagcataaaatccagctcttgcaagctgctccttgttaactgagtatatccatgtcccaaaagtaaagatccgtgcttcataatctgccatggatggatttcttggaagatttgttgaatttgggaaattcctatcagaactcacagcatcagattcacttcgaatattaagattccggcccaaaacaaagaagcaattaggaaagtgtcgcctgtgttctgaccaggcacgatcacaaggttcccaatttttcagttttccaccacaacaaaagcactgcacttggtcaccaatacctgtgtagtagagtccagcacttgctaactctcttggggttaggtgagcatagtctggccagttctgaaaggactttaatctagcttcttcactatacatggcagggttcctcgggtatatggtgtctgatatatctacaacctgcccagttctcaaaagatagtctgcatgtgtctcagatggcctgtctaaggcaaaatgatctctgcttcccagatagttttcaactttgtactgaccattctggataccagaatttgtagactgcgtggcactattttcaagataaaagccgttgataaatctgcaatttggggatactttcctgtgtcttccaactgctgagtctccatattgccatctatctacagctgcatgacaactaaagcaccgcacggtatctccttcaccagtataaagaaaccctgctcgtgccagtgttgatgctgaaacaggactaccacttggaaaattagcaaaagtttttaatctattaaactcttctacaaattcttcttccttattgatgtctgcaggtacacaagttttagatccttcaaaactgttaaaagtcat

SEQ ID NO: 111 - DNA, 843 bp, synthetic construct
  misc_feature 1..843: note = d2EGFP
  source 1..843: mol_type = other DNA
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagagccatggcttcccgccggaggtggaggagcaggatgatggcacgctgcccatgtcttgtgcccaggagagcgggatggaccgtcaccctgcagcctgtgcttctgctaggatcaatgtgtagtag

SEQ ID NO: 112 - DNA, 1999 bp, Bos taurus
  source 1..1999: mol_type = genomic DNA
tagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattcgttttgtgcagaaattttaaggtgactacacgcttagcccaactacccttgggaaatgtgtgtgtgttagtcactcaatcgtgtccagctctttgtgaccccatggactgtagcctgccaggctcctctgtccatgggattctccaggcaagaatactggagtgggttgccattccccaggggattttcccaacccaaggatcaaacccgagtttcctgcattgcaggcagattctttactctctgagccatcagggaagccctgtgggaaatgggaaccatgcaaaaacggctttgggaccaataagaccagaatatttgggatctgaactggcgcaagaaatgtggaagagagattctaaatgcatgtgtacatactaagttgcttcagtcatgtccgactatttgcaaccccatggaccacagcctgccaggctcctctgtccatgggattctccagtcaagaatactggagtgagtttccatttcctcttccaggggatcttccagacccagggatcaaaccagtgtctcttatgtctcctgtgttgacaggcaggttctttaccactagtgccacctgagacccaattctaaacgaggggttgcaaattcagtgccaacaggtgccaggtataagtggcaagggctgcatgtgaagggagaaatagcaaccagcccttaggctgcttgtgaaggatacagcacagaggggtgggaaccagggcagcctgaagtctcaggccccagctaaggatgtggcccagccagccttgttacattgcctgatcctgcattcaggactgcaggaggactttcctggtggtccagtggttgagaatccacatgccaatgcaggggacacgggttcaatccctgatctgggaagattccacatgcctcagggcaactacgcccgtacatcacaactaccgaagccctcgcacctagagcctgtgctctgcaacaggagaagccactcagggagaagcctgctcaccacaactagaaagtacagtagcccctgctcgctgcaactggagaaagccctcttgcagcaaccaacacccagcacagccaaaactaaatatatatatattttaaaagacctcaggggacttccctggtggttcagcgtgtaaggctctgtgtttccaatggagggggcccaggttcaacccctggttggagaactagatccctcatgctgaaattaaagatcccaagtgctgcaacctgactcagccaaaaaaaaaaaaaaaagctcagatgcagggctgccagaccttctgattctttgagacagacagggtatctagactttcatgtaaaatcaaatgtttacacattggcaactaattcatagtgaaaacattttaagggcaaaatttaacccaaacacatttgctcttcaagctgtcagtgagcaatttgttattagaggaatggattgggataactt

SEQ ID NO: 113 - DNA, 1500 bp, Homo sapiens
  source 1..1500: mol_type = genomic DNA
ctgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctga

SEQ ID NO: 114 - DNA, 1280 bp, Homo sapiens
  source 1..1280: mol_type = genomic DNA
taagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaa

SEQ ID NO: 115 - DNA, 1232 bp, Homo sapiens
  source 1..1232: mol_type = genomic DNA
gctcgctttcttgctgtccaatttctattaaaggttcctttgttccccaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaagggggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaa

SEQ ID NO: 116 - DNA, 1235 bp, Homo sapiens
  source 1..1235: mol_type = genomic DNA
taagctcgctttcttgctgtccaatttctattaaaggttcctttgttccccaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaagggggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaa

SEQ ID NO: 117 - DNA, 154 bp, synthetic construct
  misc_feature 1..154: note = SPA
  source 1..154: mol_type = other DNA
agagaaatgttctggcacctgcacttgcactggggacagcctattttgctagtttgttttgtttcgttttgttttgatggagagcgtatgttagtactatcgattcacacaaaaaaccaacacacagatgtaatgaaaataaagatattttatt

SEQ ID NO: 118 - DNA, 1256 bp, synthetic construct
  misc_feature 1..1256: note = SPAhsACTBpA
  source 1..1256: mol_type = other DNA
aataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacggagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccg

SEQ ID NO: 119 - DNA, 238 bp, synthetic construct
  misc_feature 1..238: note = SV40LatepA
  source 1..238: mol_type = other DNA
ggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattat

SEQ ID NO: 120 - DNA, 1999 bp, Bos taurus
  source 1..1999: mol_type = genomic DNA
aagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaacta

SEQ ID NO: 121 - DNA, 2000 bp, Bos taurus
  source 1..2000: mol_type = genomic DNA
aagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagctttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaacta

SEQ ID NO: 122 - DNA, 2002 bp, Bos taurus
  source 1..2002: mol_type = genomic DNA
aagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagctttttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaacta

SEQ ID NO: 123 - DNA, 1256 bp, synthetic construct
  misc_feature 1..1256: note = SPAACT1
  source 1..1256: mol_type = other DNA
aataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacagagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccg

SEQ ID NO: 124 - DNA, 1431 bp, synthetic construct
  misc_feature 1..1431: note = SPAPTCH2pA
  source 1..1431: mol_type = other DNA
agttaggggctattgcaattatccagcaagagatcttggaccaggatggcagcagtggaggtggtaaaatgtggttggatgaagcgtacgctttgaaggtatcaacaggaccagctgatggaagggagtcaacaggactagctgatggctgtaaactggggggtcactagctatcagatggcatttacttaaagccatggaagtaggtgagctcccttatggagagggaataggaaggaggtagaccattctatcaaaatgctctttctacagggcacttctcactgagatattatttatctgggatttatattatttattcaatttgttttgtgtttggttctattagaaaagctccataggggccgggcacgttggcttttgcctgtaatcccaacactttggaaggccgaggcaggcggattacctggggtcaggagtttgataccagcctggccaacatggtgaaactctgtctctactaaaaacacaaaaattagccgggcgtggtggtgcgcctgtaatcccagatgctgaggaggagaatcgcttgaacccgggaggtggaggttgcagtgagccgagatcgcgccactgcactccagcctgggcaacaagagcgaaactccctctcaaaaacaaacaaacaaacaaacaaacaaacaaaaaacaaaaaaaagaaagaaagaaagaaaagggccaggtgtggtggctcacacctgtaatcccagcactttgggaggctgaggcaggcggatcacgaggtcaggagatcgataccatcctcaccaacacggtgaaaccctgtctctactaaaaatacaaaaattagtcgggtgtggtggcgggcgcctgtagtcccaggtactccgcaggctgaggcaggagaatcgcttgaacccgggaggcggaggttgtagtgagccgagattgagccactgcactccagcctgggtgacaaagtgagactccatctcaaaagaaaaaagctccataggagaaggaaccttgtctcttcaccacataaactgtgtttggattcgcaatcgagttgggaaaaaaaaatcagtctggaagagccacaccaaaccgctaacagctactgtctctgggaatagaacaaggagtttggttggcgcgatataccgcccctgaacctctagccacaataaggcttaattaatgaccggacgacttgaaagcgccttccactgtttatctcttaaatctgcaacgaaatgcaacaaaaacgcaagaaataaacaatagaagcctcaagagaaatgttctggcacctgcacttgcactggggacagcctattttgctagtttgttttgtttcgttttgttttgatggagagcgtatgttagtactatcgattcacacaaaaaaccaacacacagatgtaatgaaaataaagatattttatt

SEQ ID NO: 125 - DNA, 154 bp, synthetic construct
  misc_feature 1..154: note = synthetic pA
  source 1..154: mol_type = other DNA
aataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctct

SEQ ID NO: 126 - DNA, 1648 bp, Homo sapiens
  source 1..1648: mol_type = genomic DNA
gtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttg

SEQ ID NO: 127 - DNA, 1640 bp, Homo sapiens
  source 1..1640: mol_type = genomic DNA
tcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttg

SEQ ID NO: 128 - DNA, 1646 bp, Homo sapiens
  source 1..1646: mol_type = genomic DNA
tcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggtt

SEQ ID NO: 129 - DNA, 1771 bp, Homo sapiens
  source 1..1771: mol_type = genomic DNA
ggcgtccgggctgactgcagcccgcaggtgagctgggccggccgccttgccctgactcgctgttgtcactcccaaacacggggtcgcgagctaacgttgcagggccccggactccgcgtggggaccccggccccgccccccagcctgtcgagtcaatctgaacgctctgcgacctcgggcgagtccgtcccctcactgcgcggcctcactgccacccctacgcggccggcgctccaaccctgaaaattccagcagcgcacaaggaaaccgtagtgccgggcgcctctcggggtgtaaccaaagcaccggcgccgctcctggcgaggagtgagcgccctggacaagcctgtggctaaacccacgccagccctgatcgctgctcttaactagcatcgtaaacagaagagggtatccccccgaccgcccgaagctggggagccgaccttcaaaaaagtcagggctcccattgtctacctcagtttccctataatgtctacaggtgaccagaatgaaacaaaggcctcactccacaccaccttctcagcacataagggggcggggtagccccaacccggagcgcgcgcctggggacaatcaggcctgtgatttgaggggcagggatgtgtcgggtcgggtagaaaggggcctcggtcttcaaacgaacggagatccggggcagggcgccccgtggagggacctgcatggtggtggctgcgcttggggacgggcgggctgtttcctatggtgaccggggcgaggtgagggctcctgagagctcccccgcgcccagggacgcagagcgtcgcggacccccgccgcgccccttcctcagcccggcactggcgcccgagatcctcgtggagcccgaggggaaagattgcaagggacgtcccagggagcaaagccccgcagcgtggccggggactcggggacccaccccagctccggcgcggccccgccccgggtcaggcagtttcggggcgcagcagggccctccccacggcgcggcagtcccggggaggggccaggcccgtcagcccttcggccctcccggcgaccctcggagggcgccccaactcagacccgcccgccggcccgcgcagggtcgcgagcgcgcgggggtggcgcgggcggggccgttgggaggcggtgcgggctgggggcggggcgggccggggccccacgtgtccctgcccggcgggccaatgggtgcccggctttcggaaagatcgccatatatggacatgttctggggccgcgcgcgccgccgggccgcgcgggcgcgccgcttccgcttaaataacggcgggggaggccgcggtcggtctcagtcgccgctgccagctctcgcactctgttcttccgccgctccgccgtcgcgtttctctgccggtgagcgccccgccccggggcctgagctggacgtcgcaggcctgcgccccccgaccccggctggccccgcttccagctgccgaggcctcgtcgcgccttccccgggaacaaaaggcggggtgggccgggtcaggcggacggggctgggggggcgccgggggtccagggcggggcccggccgcagtgcagacttccgagccgtggacgttacgtaaaaggcccggccttcggttccaggcggttgcgatcttggaggccacggccgctggggttggggcagggccgaggcttccccgcgggagggcattaggtggctgtggggaggggaccgtgttacagacgcgcccgcctgagtccatccttttccgggcaggtcgca

SEQ ID NO: 130 - DNA, 1186 bp, Homo sapiens
  source 1..1186: mol_type = genomic DNA
tcacgacacctgaaatggaagaaaaaaactttgaaccactgtctgaggcttgagaatgaaccaagatccaaactcaaaaagggcaaattccaaggagaattacatcaagtgccaagctggcctaacttcagtctccacccactcagtgtggggaaactccatcgcataaaacccctccccccaacctaaagacgacgtactccaaaagctcgagaactaatcgaggtgcctggacggcgcccggtactccgtggagtcacatgaagcgacggctgaggacggaaaggcccttttcctttgtgtgggtgactcacccgcccgctctcccgagcgccgcgtcctccattttgagctccctgcagcagggccgggaagcggccatctttccgctcacgcaactggtgccgaccgggccagccttgccgcccagggcggggcgatacacggcggcgcgaggccaggcaccagagcaggccggccagcttgagactacccccgtccgattctcggtggccgcgctcgcaggccccgcctcgccgaacatgtgcgctgggacgcacgggccccgtcgccgcccgcggccccaaaaaccgaaataccagtgtgcagatcttggcccgcatttacaagactatcttgccagaaaaaaagcgtcgcagcaggtcatcaaaaattttaaatggctagagacttatcgaaagcagcgagacaggcgcgaaggtgccaccagattcgcacgcggcggccccagcgcccaggccaggcctcaactcaagcacgaggcgaaggggctccttaagcgcaaggcctcgaactctcccacccacttccaacccgaagctcgggatcaagaatcacgtactgcagccaggtggaagtaattcaaggcacgcaagggccataacccgtaaagaggccaggcccgcgggaaccacacacggcacttacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagcctcaggca

SEQ ID NO: 131 - DNA, 1186 bp, Homo sapiens
  source 1..1186: mol_type = genomic DNA
tcacgacacctgaaatggaagaaaaaaactttgaaccactgtctgaggcttgagaatgaaccaagatccaaactcaaaaagggcaaattccaaggagaattacatcaagtgccaagctggcctaacttcagtctccacccactcagtgtggggaaactccatcgcataaaacccctccccccaacctaaagacgacgtactccaaaagctcgagaactaatcgaggtgcctggacggcgcccggtactccgtggagtcacatgaagcgacggctgaggacggaaaggcccttttcctttgtgtgggtgactcacccgcccgctctcccgagcgccgcgtcctccattttgagctccctgcagcagggccgggaagcggccatctttccgctcacgcaactggtgccgaccgggccagccttgccgcccagggcggggcgatacacggcggcgcgaggccaggcaccagagcaggccggccagcttgagactacccccgtccgattctcggtggccgcgctcgcaggccccgcctcgccgaacatgtgcgctgggacgcacgggccccgtcgccgcccgcggccccaaaaaccgaaataccagtgtgcagatcttggcccgcatttacaagactatcttgccagaaaaaaagcgtcgcagcaggtcatcaaaaattttaaatggctagagacttatcgaaagcagcgagacaggcgcgaaggtgccaccagattcgcacgcggcggccccagcgcccaagccaggcctcaactcaagcacgaggcgaaggggctccttaagcgcaaggcctcgaactctcccacccacttccaacccgaagctcgggatcaagaatcacgtactgcagccaggggcgtggaagtaattcaaggcacgcaagggccataacccgtaaagaggccaggcccgcgggaaccacacacggcacttacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagcctca

SEQ ID NO: 132 - DNA, 1182 bp, Homo sapiens
  source 1..1182: mol_type = genomic DNA
tcacgacacctgaaatggaagaaaaaaactttgaaccactgtctgaggcttgagaatgaaccaagatccaaactcaaaaagggcaaattccaaggagaattacatcaagtgccaagctggcctaacttcagtctccacccactcagtgtggggaaactccatcgcataaaacccctccccccaacctaaagacgacgtactccaaaagctcgagaactaatcgaggtgcctggacggcgcccggtactccgtggagtcacatgaagcgacggctgaggacggaaaggcccttttcctttgtgtgggtgactcacccgcccgctctcccgagcgccgcgtcctccattttgagctccctgcagcagggccgggaagcggccatctttccgctcacgcaactggtgccgaccgggccagccttgccgcccagggcggggcgatacacggcggcgcgaggccaggcaccagagcaggccggccagcttgagactacccccgtccgattctcggtggccgcgctcgcaggccccgcctcgccgaacatgtgcgctgggacgcacgggccccgtcgccgcccgcggccccaaaaaccgaaataccagtgtgcagatcttggcccgcatttacaagactatcttgccagaaaaaaagcgtcgcagcaggtcatcaaaaattttaaatggctagagacttatcgaaagcagcgagacaggcgcgaaggtgccaccagattcgcacgcggcggccccagcgcccaggccaggcctcaactcaagcacgaggcgaaggggctccttaagcgcaaggcctcgaactctcccacccacttccaacccgaagctcgggatcaagaatcacgtactgcagccaggtggaagtaattcaaggcacgcaagggccataacccgtaaagaggccaggcccgcgggaaccacacacggcacttacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagcctca

SEQ ID NO: 133 - DNA, 1330 bp, Homo sapiens
  source 1..1330: mol_type = genomic DNA
cccggctcccgcgcccaaacccctcccttcaggccccgcgcgattccgcccccagttctgtgccggccaagatcccggctagcgccgctatcattggttagttccaagtttgcccgcccctcttcctcctcctttttccgccccctccctcccgcggaagctgggggcgcatgcgtagaggtggacgctcccctcccccgcccggggtaactgaggactcccgcgcgcggactcgctgcgccccaccctccctttccccggggccgtccggagagcgggggcgagcttgaaagttccagaacgctgcggtgagtgcgttatcgtgaggcggagcgcggtggggtgggtgcggaagggggcgaggcccgaggagtggagccgggcttgtgattgggtcttgtaagggcagccgggcgtctattggccggggaagccgtaatggcaggcagcaggggcgggccccttctggaaggttctaagatagggtataagaggcagggtggcgggcggaaaccggtctcattgaactcgcctgcagctcttgggttttttgtggcttccttcgttattggagccaggcctacaccccaggtaaaacctctgctcaagagttgggttgtgggtctgggagcgtgcagcctccacacaggcctgttgggcttgctgaggcttgggggttctgagaatctcgtcgaggcgagtgtgcggctccttctaccggcttaaagggcctcagttttcggtgggatggcagcggtatttggttgcagccggcaggacggaaatgtagggagtgggccgcagtggccccaggggaggctgggagacgcccggcggccgcgtggcgggggagggttgctgcatcggtttgcctggcgcgcggggaagtggagccagcgttttctttcacccagttccctgcttagtccagtcccaccgtggttcttcagagctgttcttggcgtgcttccagtatgggggtacattccggagtagttaaaagcccgttgactcccgggggcactggcacctggcgagggaggggaacagacagtgctcagttcggggtaagaccacgtgttgagcaacgccccacgccgtctgggtagatgggtccttcatctagggcgtgctctgctgcggttggcacggcaacctggactgcagcactagttctggacctcgcgcgtgcttagacaggaggtgatgggcactattacctcttggcagtggccatacgtttttcctggttaagtgttctgttaagggatgagggaaatattttgattaattgaatttttaaaccagatttttctttttttcagcaacc

SEQ ID NO: 134 - DNA, 1136 bp, Mus musculus
  source 1..1136: mol_type = genomic DNA
tgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaa

SEQ ID NO: 135 - DNA, 1138 bp, Mus musculus
  source 1..1138: mol_type = genomic DNA
tgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaa

SEQ ID NO: 136 - DNA, 946 bp, Sus scrofa
  source 1..946: mol_type = genomic DNA
ttagcttttagcgatggctttcacgacacctaagacgacaaaaaccttctttaaactactgtcccgacgaccggagactcaggcacaaccccaacagccaagggcaaactccagggagcattagcaccggcgccctgcgggccctgcccggcctacacccagcgaacggggccgccccggcgcccagcccctcccccacccgggccgcgagtcccgggaagcggcgcgggcagcaccgcccggccctttgtgcgccgcccgccgtccgcgtcctccatcttgagaccgggagcggccatctttccgcgctcgcagcccgcccgggcggggcgctgggtctccgaccgcccgccccgccccgccgcggccgtctgccccgggaccgccgggcacggaggccaccttgggcggcctcggctgggccgccctggcagtaacacgcggctgccggccgaactcgagcgcgaagacagacggggcgggcgcgaaggcgcggatcgcacgcggcggccacggcgccccagcaggccgccaccgggcacgcggtagggaaccgcgagagcggagggcctcgagttctccacctccccccgcccgcagctcggaatcaggaccagggcgcagagccctctacgcgcggggggccgggaggcacgctaaggccgtggccaccggcggaggccatgcggacggaggccacacccgtactcacctgtgtcctggcggcaaacccgttgcgaaaaagaacgttcgcggggaccacggcgcttatatatggtcctcccccaccctcggggaaaagggcggagccagcacacgacaccactttcccagtttaccccgcgccacctccacccggcaccggttccaccgccgtcccctccccccatcttcggggaccgtgggcgatgtgcgttcagcccactgacgagcacacggcgcccgg

SEQ ID NO: 137 - DNA, 2123 bp, Sus scrofa
  source 1..2123: mol_type = genomic DNA
tttcccatttttgcttagcttttagcgatggctttcacgacacctaagacgacaaaaaccttctttaaactactgtcccgacgaccggagactcaggcacaaccccaacagccaagggcaaactccagggagcattagcaccggcgccctgcgggccctgcccggcctacacccagcgaacggggccgccccggcgcccagcccctcccccacccgggccgcgagtcccgggaagcggcgcgggcagcaccgcccggccctttgtgcgccgcccgccgtccgcgtcctccatcttgagaccgggagcggccatctttccgcgctcgcagcccgcccgggcggggcgctgggtctccgaccgcccgccccgccccgccgcggccgtctgccccgggaccgccgggcacggaggccaccttgggcggcctcggctgggccgccctggcagtaacacgcggctgccggccgaactcgagcgcgaagacagacggggcgggcgcgaaggcgcggatcgcacgcggcggccacggcgccccagcaggccgccaccgggcacgcggtagggaaccgcgagagcggagggcctcgagttctccacctccccccgcccgcagctcggaatcaggaccagggcgcagagccctctacgcgcggggggccgggaggcacgctaaggccgtggccaccggcggaggccatgcggacggaggccacacccgtactcacctgtgtcctggcggcaaacccgttgcgaaaaagaacgttcgcggggaccacggcgcttatatatggtcctcccccaccctcggggaaaagggcggagccagcacacgacaccactttcccagtttaccccgcgccacctccacccggcaccggttccaccgccgtcccctccccccatcttcggggaccgtgggcgatgtgcgttcagcccactgacgagcacacggcgcccggcgcatgctcctctcaaccaggaggatgacgactgctggtgggtgggaggcggggtcgagcgctcactcggttctaggtttagtgggagtttatcgacggtccctgggatttccctggctgaggagagtcctccttttgtatgaattactctccgcacagctggggggtggggcggcggggaggcgtccagaatcttccctgaaccggtcgtagcttaactgcaaagttggaccgagatgggagcccttacccggcagtaccccaccggtcctcagtcttgcggtctcgcaggttaaggactaacccctggagccgcttcctctgccggggcttctccaccgcccttgccgtccgcgccccttccggctggagagggaggcgtaaaaggccggggaaccgcggcggcaggggcctcggggcggtcttcagggccgagaatccgcgagtggctcagtttgctgaccaacagcctggcgaacaggctcctgcgctgacctcttggctttttccattcagttcttttatctaagttcgttctacacaccacgtggtactccagacgtccagtttttgagtttagaatagacttaagtactacagttttctttacttctaatcctaattttattacgtttaagaccctgagtgtgtgtctaccctcctattaacattttttttccagtgtatactcttggttgcaagcatgaaaaacctaaaaagaattttttgagttcagtgcttatacacgatctcaagtagagactaagatctacagcgccaggaagcttatccacccaatttactactccaacgtttgctgtgaaatcactgtttctcaaaaatggcctatcccatttgaataaacggcttcatcttttgtcgtcctatccattgtgactgcattttaggcataaatccagggcaagacaagatgaggcctttttggttggcaatcaggcagatattcaaaaatattcctgaagaaagaggaacctttattttaaatgagctaattactagatcgtctcttccacgtgtagagcactactgcaactttttgagccaatctatcaacaaatatttgagaacctactatgtggccagagctaagagtggctccgaagcatatgcaaaagaaatacttcctttgggggaagaaaccc

SEQ ID NO: 138 - DNA, 2115 bp, Sus scrofa
  source 1..2115: mol_type = genomic DNA
ttttgcttagcttttagcgatggctttcacgacacctaagacgacaaaaaccttctttaaactactgtcccgacgaccggagactcaggcacaaccccaacagccaagggcaaactccagggagcattagcaccggcgccctgcgggccctgcccggcctacacccagcgaacggggccgccccggcgcccagcccctcccccacccgggccgcgagtcccgggaagcggcgcgggcagcaccgcccggccctttgtgcgccgcccgccgtccgcgtcctccatcttgagaccgggagcggccatctttccgcgctcgcagcccgcccgggcggggcgctgggtctccgaccgcccgccccgccccgccgcggccgtctgccccgggaccgccgggcacggaggccaccttgggcggcctcggctgggccgccctggcagtaacacgcggctgccggccgaactcgagcgcgaagacagacggggcgggcgcgaaggcgcggatcgcacgcggcggccacggcgccccagcaggccgccaccgggcacgcggtagggaaccgcgagagcggagggcctcgagttctccacctccccccgcccgcagctcggaatcaggaccagggcgcagagccctctacgcgcggggggccgggaggcacgctaaggccgtggccaccggcggaggccatgcggacggaggccacacccgtactcacctgtgtcctggcggcaaacccgttgcgaaaaagaacgttcgcggggaccacggcgcttatatatggtcctcccccaccctcggggaaaagggcggagccagcacacgacaccactttcccagtttaccccgcgccacctccacccggcaccggttccaccgccgtcccctccccccatcttcggggaccgtgggcgatgtgcgttcagcccactgacgagcacacggcgcccggcgcatgctcctctcaaccaggaggatgacgactgctggtgggtgggaggcggggtcgagcgctcactcggttctaggtttagtgggagtttatcgacggtccctgggatttccctggctgaggagagtcctccttttgtatgaattactctccgcacagctggggggtggggcggcggggaggcgtccagaatcttccctgaaccggtcgtagcttaactgcaaagttggaccgagatgggagcccttacccggcagtaccccaccggtcctcagtcttgcggtctcgcaggttaaggactaacccctggagccgcttcctctgccggggcttctccaccgcccttgccgtccgcgccccttccggctggagagggaggcgtaaaaggccggggaaccgcggcggcaggggcctcggggcggtcttcagggccgagaatccgcgagtggctcagtttgctgaccaacagcctggcgaacaggctcctgcgctgacctcttggctttttccattcagttcttttatctaagttcgttctacacaccacgtggtactccagacgtccagtttttgagtttagaatagacttaagtactacagttttctttacttctaatcctaattttattacgtttaagaccctgagtgtgtgtctaccctcctattaacattttttttccagtgtatactcttggttgcaagcatgaaaaacctaaaaagaattttttgagttcagtgcttatacacgatctcaagtagagactaagatctacagcgccaggaagcttatccacccaatttactactccaacgtttgctgtgaaatcactgtttctcaaaaatggcctatcccatttgaataaacggcttcatcttttgtcgtcctatccattgtgactgcattttaggcataaatccagggcaagacaagatgaggcctttttggttggcaatcaggcagatattcaaaaatattcctgaagaaagaggaacctttattttaaatgagctaattactagatcgtctcttccacgtgtagagcactactgcaactttttgagccaatctatcaacaaatatttgagaacctactatgtggccagagctaagagtggctccgaagcatatgcaaaagaaatacttcctttgggggaagaaaccc

SEQ ID NO: 139 - DNA, 2509 bp, Sus scrofa
  source 1..2509: mol_type = genomic DNA
ggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatg

SEQ ID NO: 140 - DNA, 1330 bp, Sus scrofa
  source 1..1330: mol_type = genomic DNA
ggttgctgaaaaaaagaaaaatctggtttaaaaattcaattaatcaaaatatttccctcatcccttaacagaacacttaaccaggaaaaacgtatggccactgccaagaggtaatagtgcccatcacctcctgtctaagcacgcgcgaggtccagaactagtgctgcagtccaggttgccgtgccaaccgcagcagagcacgccctagatgaaggacccatctacccagacggcgtggggcgttgctcaacacgtggtcttaccccgaactgagcactgtctgttcccctccctcgccaggtgccagtgcccccgggagtcaacgggcttttaactactccggaatgtacccccatactggaagcacgccaagaacagctctgaagaaccacggtgggactggactaagcagggaactgggtgaaagaaaacgctggctccacttccccgcgcgccaggcaaaccgatgcagcaaccctcccccgccacgcggccgccgggcgtctcccagcctcccctggggccactgcggcccactccctacatttccgtcctgccggctgcaaccaaataccgctgccatcccaccgaaaactgaggccctttaagccggtagaaggagccgcacactcgcctcgacgagattctcagaacccccaagcctcagcaagcccaacaggcctgtgtggaggctgcacgctcccagacccacaacccaactcttgagcagaggttttacctggggtgtaggcctggctccaataacgaaggaagccacaaaaaacccaagagctgcaggcgagttcaatgagaccggtttccgcccgccaccctgcctcttataccctatcttagaaccttccagaaggggcccgcccctgctgcctgccattacggcttccccggccaatagacgcccggctgcccttacaagacccaatcacaagcccggctccactcctcgggcctcgcccccttccgcacccaccccaccgcgctccgcctcacgataacgcactcaccgcagcgttctggaactttcaagctcgcccccgctctccggacggccccggggaaagggagggtggggcgcagcgagtccgcgcgcgggagtcctcagttaccccgggcgggggaggggagcgtccacctctacgcatgcgcccccagcttccgcgggagggagggggcggaaaaaggaggaggaagaggggcgggcaaacttggaactaaccaatgatagcggcgctagccgggatcttggccggcacagaactgggggcggaatcgcgcggggcctgaagggaggggtttgggcgcgggagccggg

SEQ ID NO: 141 - DNA, 2237 bp, Sus scrofa
  source 1..2237: mol_type = genomic DNA
ctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagaca

SEQ ID NO: 142 - DNA, 2558 bp, Sus scrofa
  source 1..2558: mol_type = genomic DNA
aagaataggtggtgccaagatcaatgccaactgcaggtcccttagacatggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatg

SEQ ID NO: 143 - DNA, 2558 bp, Sus scrofa; identical to SEQ ID NO: 142
  source 1..2558: mol_type = genomic DNA

SEQ ID NO: 144 - DNA, 1330 bp, Sus scrofa; identical to SEQ ID NO: 140
  source 1..1330: mol_type = genomic DNA

SEQ ID NO: 145 - DNA, 2509 bp, Sus scrofa; identical to SEQ ID NO: 139
  source 1..2509: mol_type = genomic DNA

SEQ ID NO: 146 - DNA, 34 bp, synthetic construct
  misc_feature 1..34: note = Lox66
  source 1..34: mol_type = other DNA
ataacttcgtatagcatacattatacgaacggta

SEQ ID NO: 147 - DNA, 34 bp, synthetic construct
  misc_feature 1..34: note = LoxP
  source 1..34: mol_type = other DNA
ataacttcgtataatgtatgctatacgaagttat

SEQ ID NO: 148 - DNA, 34 bp, synthetic construct
  misc_feature 1..34: note = LoxP
  source 1..34: mol_type = other DNA
ataacttcgtatagcatacattatacgaagttat

SEQ ID NO: 149 - DNA, 34 bp, synthetic construct
  misc_feature 1..34: note = LoxP2272
  source 1..34: mol_type = other DNA
ataacttcgtataaagtatcctatacgaagttat

SEQ ID NO: 150 - DNA, 34 bp, synthetic construct
  misc_feature 1..34: note = LoxP2272
  source 1..34: mol_type = other DNA
ataacttcgtataggatactttatacgaagttat

SEQ ID NO: 151-153 - skipped (3 entries)

SEQ ID NO: 154 - DNA, 1102 bp, Homo sapiens
  source 1..1102: mol_type = genomic DNA
cggcatccctgcaagggatcctcacccccttttcttccttcattctctgctggtgtcaatcacagcttctagcagagggaaggcaggccaggcttggtttcttcttgcgagagtatttaactcagggccctgtagaacaatgagaatctgacctgcaactagctgggcgtgctggggcatgcctgtgtagtttcagctacttgggaggctgaggcaggagaattgcttgagcccaaagttgaggctgcagtgagccatggttgtgccattacactccagcctgggcaacacaagacccctgctcagaaataaaaagagaacctggcctgcagtgccaggcaggccctgaggtccaggagcctgggtatctccctctgcagcatgggtcacgaacaaactgggccctcagaggccacgggatggcgcccagtctccagtcacaaggcagaatccagacctcagcccatagctaaccagagctgtctgcaggccagatatggccccatggaccccctaccccaacttgactttgattccaggtccccctccgtctggatgaacaggtaggaattgcggcctctcctaagcctatgggagcctgggccaggctgaccctcaaggctgacagccacgatcccataggtgaaggcaaaggcgtggcagctaggaacacccactacacccccactcaagggaacaccgtgcccagctaccctgagacagccccactcccaggaaatgcaggtgccaaccagccccagtgaggcatggcacctgagccagacacccccaaatagtcccttcccacctcctcaagcatctgcactctgggtgaacccagaaaaactggggtacctggggagacatagaagggccaggccaggaactccccaataagcaggaacaggaacctgacccctgagcctcccccaccctctaaggctgctcaatgtcaaggcaggagggatctccacacacctgcactctgggtaaggacaagttggcccccactgccccacccttttgcagggttcaccctcctgcagggttcaccctctgctgcccccaacccagccacaccacaaagtcacacttggcctca

SEQ ID NO: 155 - DNA, 1102 bp, Homo sapiens
  source 1..1102: mol_type = genomic DNA
tgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacagagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccg

SEQ ID NO: 156 - DNA, 1102 bp, Homo sapiens; identical to SEQ ID NO: 155
  source 1..1102: mol_type = genomic DNA

SEQ ID NO: 157 - DNA, 1554 bp, Homo sapiens
  source 1..1554: mol_type = genomic DNA
ccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctctcccacggaggcggctggccgacttccactgaggcgccaacggcctcgccatgcccttttcaataactcattgatttcaaacccgttacgtccatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggcc

SEQ ID NO: 158 - DNA, 1102 bp, Homo sapiens
  source 1..1102: mol_type = genomic DNA
tgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacggagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccg

SEQ ID NO: 159 - DNA, 1996 bp, Bos taurus
  source 1..1996: mol_type = genomic DNA
aagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaa

SEQ ID NO: 160 - DNA, 2000 bp, Bos taurus
  source 1..2000: mol_type = genomic DNA
taagctccctttcctgctttccaggaaaggttttttcatcctcagagcccaaagattgaatatggaaaaattatgaagtgttttgagcatctggcctctgcctaataaagacatttattttcattgcactggtgtatttaaattatttcactgtctcttactcagatgggcacatgggagggcaaaacactgaagacataaagaaatgaagggctagtcgagaccttgagaaaatatatcagtatcttggaccccatgacagcagtggttgtaaatagctgatgttatggaaaacaggctttgctccttagccttactctcccttaaagaattcaagttgcagcttgatttgggagttagatattgctaaattttatttaaataaattatgttatttaccctttcttgtaaatgtcttctttctctttaattatccagaatatcacttagattcattaagttcttctgcctaattacaccactgttttaagattttctttttgcattttactgtccccatttctctttctcccctgttctctttttatcctagttttctctgccatcttaaaagaactacaagaaagacagaaccttctgtgctggattcggaaaatgacatatgaattatgagtaatccttgttccttcttgcatcctaattctgaatctcagttcagttcacttcagtctctcagttatgtacgattctttgcaatcccatggactgcagcataccaggctcccctgtccatcaccaactcctggagcttgcttaaattcatgtccatcgagttggtgatgccattcaaccatttcatcctctgtcgtccccttcctctgctttcaatctttcccagcatcagggtcttttccagtgagtccgttcttcacatcaagtggccaaagtgttgaagtttcagcttcagcatcggtccttccaataaatattcaggacttatttcctttaggtttgactggtttcatctccttgcaccccaaggtactctcgagagtcttctccaacatcgcaatccgatggcatcaattctttggcagtcagctttctttatgatccaactctcacatccatacatggctactggaaaaaccatagctttgactagatggaactttgtcggccaagcaatgtctctgctttttaataagctgtctagctttttatagacagcttattatagcttgttatagcttttcttccaaggagcaagcatcttttaatttcatgtctgcagtcaccatatgcagtgactttggaggccaggaaaataaagtctgtcactatttccactgcttccatctctttgcaatcaagtgatgggaccggatgccatggtcttcattttttgactgttgagttttaagacagctttttaattctcttctttcactttcatgaagaggctgtttagttcctctttggtgtctgccataagggtgggtgtcatctgtatatatgaagttattgatatttctcctggcaaccttgattccagcttgtgcttcatccagccctgcatttctcatgatgtactctgcatagaagttaaataatcgaggtgacaatacgcagctttgacctatttctttccctgttctgaatccagttggggagatgctgaaagtaacacatctaacaagtgactgtaaatgagtgtattcaaggtttttatgagatcagataatgaagcccttggtatgaaatgggtagtaaagataagtagtacagacaattgtccaaaagacaagaagacaaaagtcagaaaagcaaaggatagcataggccaaatcactgatgaataatgtgtttgtgtattctgagaatttcaggtaaacagaaaaacaaatgaagcaaaactgcctgggatagaatagaatagatactatattttggtgtacactgtggacacattcttaaagttaaaaattcaccaagaagattccatctagacattactcacaagatatttgcactggtaa

SEQ ID NO: 161 - DNA, 1500 bp, Homo sapiens
  source 1..1500: mol_type = genomic DNA
tcagccacagaatgaggtgtccataggcattaaggaaagtggtagaaaagaagcacccagcgtagctcgggttagtgaaccgaggcacttcatgctgcatatttgtattgcacgtttcagtgtacatcgtgtttcacttcctatatctcgttggacacttcagtttgccatatgatatgtccagggggttcaggcacggaggaagggcctcggaagacctcggggggagaggggcaggcactgctgtgtattgatggggggattgtttgcactggttgatgatctctgaacaaccaagaagtacacaaggatctacctaactggacgtgctaagtaatttcactttggggattattctccagggagacgatccattgatagagaagtgaaaagcatcgagatgtgtctagtagttgtaggaagtctggggtgctttcctgatggggtgccctcagctggaaatagcccctccttcctttgacctgtcctgtggctatttgcagacattttattcctcttaccagactgtaagctctttgaggctggatttctgccttttgtctattcattcattcactcattcttctattcatgcattcaccaattccacaagtagttgttgcctgtaacatgtgccagagattgtaccaggcagatgggcatatctagataagcaaaagacatgatcctttctcttctggagctaacaatctactgggggcagagataatagcaaacaagtaaatatataatggttaaatagaaatttcgaatttggaacattctcatgaggaaaacagctaagatatggagggagagaagaagccagaaggtgacgggacgaggcagctggcacagccctaggcccaggaattcaacaggcatctactgagtggacccaacgcatgagaggacagtgccaagcaagcaactcaaatgtcccaccggttgggcatggccaggtagcctatgctgtgtctggacgtcctcctgctggtatagttattttaaaatcagaaggacagggaagggagcagtggttcacgcctgtaatcccagcaatttgggaggccaaggtgggtagatcacctgagattaggagttggagaccagcctggccaatatggtgaaaccccgtctctaccaaaaaaacaaaaattagctgagcctggtcatgcatgcctggaatcccaacaactcgggaggctgaggcaggagaatcgcttgaacccaggaggcggagattgcagtgagccaagattgtgccactgcactccagcttggttcccaatagaccccgcaggccctacaggttgtcttcccaacttgccccttgctccataccacccccctccaccccataatattatagaaggacacctagtcagacaaaatgatgcaacttaattttattaggacaaggctggtgggcactggagtggcaacttccagggccaggagaggcactggggaggggtcacagggatgccacccgggcag

SEQ ID NO: 162 - DNA, 238 bp, synthetic construct
  misc_feature 1..238: note = SV40pA polyadenylation tail
  source 1..238: mol_type = other DNA
ataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcc

SEQ ID NO: 163 - DNA, 1204 bp, Gallus gallus
  source 1..1204: mol_type = genomic DNA
ctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccg

SEQ ID NO: 164 - DNA, 1203 bp, Gallus gallus
  source 1..1203: mol_type = genomic DNA
cggggacagcccccccccaaagcccccagggatgtaattgcgtccctctcccgctagggggcagcagcgagccgcccggggctccgctccggcccgacgcttcccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccagcagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcctatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgag

SEQ ID NO: 165 - DNA, 864 bp, Homo sapiens
  source 1..864: mol_type = genomic DNA
catggcataaagccctacagcaactgtcgccaccagaaagctgagtgtaaggacccatcggagaagcggagcctgggagcgggtgttgagtgggggcttccctctgggagtctccacgggggcagaatcttgcactttgttgctggcccgctggcgaagccctggtgcccgtgaggggctctggtccttggtgtcatgggtcagcagctcctgcaactcctcaaagagctggatgttgagcaggaacgcagtcttggcctcttctatcaccctctgcctgactgcgggagtcatctccagggagttcatgcgggagcggtagagctgcttgaacttggtggcactggcaatgttggggaaggtgaagaaggccaggccctcgccagagctgggcaggtccagggctttctgggcaatctttttgagcacctggcccccagacaggtcacccaggtagcgggtgtaggcgtgggccaccagcagctcgggctctgtgcgccccacctcgtggagccgcttcacatagcgctgcatggctggtgtgtaggggatgacctcctgccagcggggcccgtaccagaaggccaggtcctgctccagggcagccttgcggtgcagctcttctgggaagtagacaggggcgaagactgggctctccttgttgcgctcaatctcctcctccagggccacatagatgtggtacagggaggccatcaccagcttgaagccgtctcgggtcacctggcccttctgaaagttcctcatgaactcagcattctctgcctgggtgtgcacctccttggtggcctccttcagggcctctgacaaatcctggggcatgctgtcgggttgcggacgctccat

SEQ ID NO: 166 - DNA, 1728 bp, synthetic construct
  misc_feature 1..1728: note = thrombomodulin precursor (THBD)
  source 1..1728: mol_type = other DNA
atgcttggggtcctggtccttggcgcgctggccctggccggcctgggattccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcaactgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctga

SEQ ID NO: 167 - DNA, 4502 bp, Sus scrofa
  source 1..4502: mol_type = genomic DNA
tttcaggagcttcttggagacggtggtctccagaccactgttctcaggctgagtacagctggcactacagttaatcacctgggaccttccagactccaccaccagctgcttcgtccacgtgggtttctcgaacgcctccttgccagaccctggaagaccagagacactgggcagcaggtgtccccgcttccctgcccagtggaactgcccacggcaggccatctgatcaaggggtaggggtccaaggagaaaggccagggatggcccctctgcttctctccccttgttcagaacgtatggcctcaaatctagacccaggaggctgcccctgtccccaggctgtctccctgcctctggttgctgtccctccagctcgtgacctccagatgagtctttctcatgcacatcttctaaatccgtggagtgagaccttatttgaccttcatggcccagcccaaatgtcccctcatgaaggcctctctgaagtggaggcagcttgtgtcctctgagcccgcatggtcatgggttcgactctttcccccctccgcccttctcctgcaaatcctttttgagcatctcttgggtgccaggcactgttctaggctccggggacccagcaggacccaagcagacctcaccccacccttacagagctcacaaagtaaaggagacagaccataagcagcaaaataggcaggctgttgctggtggcaagtgactgggaagggaaatggggtgcgggtatcatgtgaaagagtgtggtcaacacaggcctcactgaaacaccgaggtttgtgcaaagacatgaaagaggttgggggagcctggcaggtgcctgcggtggggagggaaccgccagtgccaggacctcaggcagggaggagcccaggatggctggagctcagggaggaggaaggtgggggggcaggggggaggcgagtcaggaaggtcatgggaccactttgcaaatgactcacattcctgctgcctctcctttgctgcctctcccattttggagtttctagagggcagagcctgggtttcacatgtttcctttgtgctcagcacaatgctccccctgtgtgtggcatcaggccaagaaatgttccaggcacgaagacagagccctcggcgctcacctcccactcagtgatcaccagaaggtccttgatccccacctgctgggcctggcctgtgtcctgttggctcctgccacaccggcatgcccccacttagccctcagctagcagcatagaaagaaggggcaagagaggcagggaaagagaagttggcggggtttgtttgtttgttcgtttctttggctttttatggccacacccgtggcatatggaagttcccaggctaggggctgaatcggagctgtagccactggcctacaccacagccacgccagatctgagccatgtctgcaatatacacttcagctcaaggcaacaccagatctttaacccactgagtgaggccagggattgaacccacatcctcatggatactggtgggccttgttactgctgagtcacaataggaacttccaggaaagagagatttgaatcttgaatttgcccggtgccagtcgtgtggcgttgagcaaagtgctttctctctctgagcctcagtttcttcctctgggccaataatccctttcctgcagggttgtcatgaaagtacatggcaggtgtgctcagcacacggtggcattttccttcaagggccctttgaccccctcgaaggggtttcattttcactttgagtggacccagaaggtgatgccctctgctgccccctaggccacactggacaacaagctgggaactcccttcacctcccgagcatcccgcctagcccaccattcagtctccacgacctgccacatccacatgccatgaagctatggggcctgttgaactggatgcccaaaaggccaggacccccacccgctgcccggggtcatggggaagccaggctggaacagcctccggtacccatgatgggcagccgctgtgttcaaagcctccgcaacttccagccccgaagccaggggaacagacgacccaccctctgggctggcagacgcccagtcggaaaccccaggcgctggcttacctgggcagcagagcagggcgagaaaggccatgaacagtccccaggaatcaaaaggggactacttgagtggcacccacgggctggcaggaaagagctgaggaccgcctggcgagagatgggggcgcaggtcagggagtggtggccgggagccgcaatccggaacccccagccatctgtgtgccgatgaccacacttcctctcattatttgaggaagacgtggcgcccagggctcaggtctataagcaacaggcagaggaagctgggaaagagctgataagcagggataaccttgtcatcctggcatgctcccatcaggggacacatgtgacagtgctgcatgtgcacggaggacagtgatgcccacaagccccagatctggggagccccaaatcccaggggacacactgtcagggtcccctctgggaagggactatccaaagtcaggacccggccagggcatgcagtcaccatgactaagtgggcagagaaacccgggcaggaactgctggtgctttagtcaactgcctggcacaagtctgcttaaacctggacactccgctttcaatctcagccagcctctgactccctgatacaagacaacttgagggcggcactcccatcatggcgcagcggaaatgaatctgactaggaaccatgaggttgaggttcgatccctggccttgctcagtgggataaggatccggcgttgctgtggctgtggtgtaggccggcagctacagctccgattagacccctagcttggggacctccataaaaggacaaaagacaaaaaaaaaaaaaaaaaaaaagacaacttgagggaaacgcactcagcatagtccccagcagccccagcatagtccccagcaggcgcagacagaagtaactcggggaggcttcctgggctagcttagggtgcacccccactccagacagggggccttgatgggggggggtagggctgaggacttgcagtgtgtttctagagaggctttgtcaccactgagggcatccctggaaacagtgcgcaggtgaggggggattcgatggtccggggtcggggtggcgatccccccccagggagcttttcatcatgatacatccagtctccgaaggccccagttacacccagagcctcaggaccggcagggcctgggaggggcaggagaataggtctgcttgctttctcaggggtgcccctgcttggtccttttcaaagagacaccccagccttttaaggactcaggcctccattcctggattcagagggtgggatgaggtcatgcccttctcttcggctctgaggccaaaggccattgccattgtgtgcagctgtcaagtgctgccactgccaacctggatgcagggaagttcctggacagcactgggtgggcttcagaccatacagagagaagacggagaaaagggcagcgctctcaccccagaccagagatccgatgccacatgggcctgcaggaaacactcctccaagccaagctagaccctgaggaggtaaccccacgggctccgaataacaacatcgataacacagcagtaaacatttactgactacaggtcagacgctgttacaagcactccacaaatattagctaattaaccccaaactctatgtggtaagtactgttactgtccccatgttacagatggggaaactgaggcccaaagtgattaagtgacttgcccagggtcccgcacctgggagagaggtgactgccgaagcccatcacagcagaggcaagaggaggattctcaggggcctgatctccaggagaccctcgggagggaaaggcaagatggccagaggagacggctggggtcttccttgccaggaggggctgggggaaggagggtggcttatgcccagagagctccaaacagcttctggaaggcacagtgcctgtggatccctgctgcacatgcatctgggccagcctgactccatcccactggtgtccaagtgaggcttgagacccacaagtcctgcgccaaacccaccagcccctgctcctgcccatgacttcttcccatccccttgggtaggcccccttgaccagggtaccccaggcacgtgaacgtggctttgttactgcatttttatagcttatacatcgatctcccctcctgcccactggcctgtccacccgtgggggcagaagctgaatcttatgcactgcaatatccacctccgataccacactgccttgcacatggaggtgcttgataaataaatgttcaatcactagattagtgggtgggtggatggatggatgggtgagtgggtaggtgggtggacggacggatggacggatggatggatggttggatggttgggtaaacaaatgaatgaaagaaatga

SEQ ID NO: 168 - DNA, 4361 bp, Sus scrofa
  source 1..4361: mol_type = genomic DNA
gctggagcagtttgtgttctgccacagaatgcaaatacataaatgtaagcaggaaaacggacagagtagagtccctagggcttctttttattttttctctcctaagctgcagattcccttttatggttatataactgatgatgacgcaagtcaaacctttcccgtccagctctcagatttcaccctttctcttggaaagaaaatgtttgctggtcactacgtagacactctcatgacgctgagttaagtcccatacaaggtggtgaccttcaggagagctgaatcctttggggaaaggaggaaaggcagacaggtaggctccagtccaatccccaacagcccaacacccaggccctttgtgagctcagcccatcacgtgctcttgcctgcccgccaatcctgccgtgttgctgggcctctgtcactcttccattggtgccagctctgaagccatcccttctggggcacctgcaaaggatggatcagtgggtggaaggaactgaaaatggatccaatgactcatcctgcttctggcatattctagcacattgcattctaggtcaagggattttaggttgtaggaacgtgacttggtacacgatccccgaatccaagtgggacatttagactttgggagcccttctcagcaaacagaaaagcagctctaacaaaaacaacaaaaatcctccgtagagcagaatttgtcaacccattgcattgctgactttgggggctgggtaattctgtttttgtgggggactggccactgcaggatgtttagtaacatccctggcctctaccactagattttagcggcacacctcaaccccaacaccacagctgtgacaagcaaaaatgtctccagatactgccaagtgtccaccaagggaccaagtcgctcctggttgagaaccactgctctagagaaacagcatctacctccctgagagtttacttccccctcctccctttcacttcagtgcccttggacaaatgtttatttctatttgcttcaacaaaacccactgttggacttagagaccaaaattctctagtagagaattttcctgctagagacaacatcagtgttgttagcgcctaagaatattgttttctctttggagatagccctgggacccagtcctcacccttggagcctttcttcttccccctctccccctctttctccttttcaccttcccttgcctctgaaatcaggtctgtttttctctgtagtttttggactcttgaaaaaaaagctatgtcacaaagctcgtgactcagcctttaaacaacatgaatcataagacctgcagtgaaagaacagccaaaagaaaacagggtgtggtttgaagccaggcctagtcacctgagaaagaacctcagctttttgttcctctgaaaacttctttctggaattcaagaaggaaaccttatacagagctttgatgttctgttcctttaaaccctcttttcagaaatttagaaatatccctcacagaaatctctactggaagtcactgaggtctcctgctaaactgaaaaatgacattttatttttattattcatttacatttcttggtaatgaattcattctctttgaaaatgtttaaaacgataggagttaaagtctgttttgaatactgcttagacctttcccataaatacctacagacacaggttgccaaagaaaacatagttttgtttttattctcattttaagtacagtatttaaataacataatgtttataattccaacaggaatgtagtcttttcctaatagcagggtattttttagtcggttctctctttttctatatatttattgaaagcttcaagggtaaaaattaaaaacaccctccccacatttatagaaatagagaatatttctagaagagtctagaaagaacagtggctagggaattgagtgcatgagggaggtttttcattataaactatagaaaacctgttttaagttttcatcacgttcatatattttaaaacatttttaaaatatgcctttggaaaaaaatttaagtatgctttttgaaaaaaggaaaaaatatgctggagaaatgacacagagatcacaaaataaaatatcaaaatgaaaaagatctgactggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagaca

SEQ ID NO: 169 - DNA, 66 bp, synthetic construct
  misc_feature 1..66: note = P2A sequence
  source 1..66: mol_type = other DNA
aggcccggggttctcctcgacgtcaccggcctgtttcagtagtgagaaattggtggcgccgctgcc

SEQ ID NO: 170 - DNA, 26 bp, synthetic construct
  misc_feature 1..26: note = restriction site
  source 1..26: mol_type = other DNA
ggcgcgcctagggataacagggtaat

SEQ ID NO: 171 - DNA, 16 bp, synthetic construct
  misc_feature 1..16: note = restriction site
  source 1..16: mol_type = other DNA
gcgatcgcttaattaa

SEQ ID NO: 172 - DNA, 35656 bp, synthetic construct
  misc_feature 1..35656: note = 9M4 full contig
  source 1..35656: mol_type = other DNA
ggcgcgcctagggataacagggtaatataacttcgtatagcatacattatacgaacggtagctggagcagtttgtgttctgccacagaatgcaaatacataaatgtaagcaggaaaacggacagagtagagtccctagggcttctttttattttttctctcctaagctgcagattcccttttatggttatataactgatgatgacgcaagtcaaacctttcccgtccagctctcagatttcaccctttctcttggaaagaaaatgtttgctggtcactacgtagacactctcatgacgctgagttaagtcccatacaaggtggtgaccttcaggagagctgaatcctttggggaaaggaggaaaggcagacaggtaggctccagtccaatccccaacagcccaacacccaggccctttgtgagctcagcccatcacgtgctcttgcctgcccgccaatcctgccgtgttgctgggcctctgtcactcttccattggtgccagctctgaagccatcccttctggggcacctgcaaaggatggatcagtgggtggaaggaactgaaaatggatccaatgactcatcctgcttctggcatattctagcacattgcattctaggtcaagggattttaggttgtaggaacgtgacttggtacacgatccccgaatccaagtgggacatttagactttgggagcccttctcagcaaacagaaaagcagctctaacaaaaacaacaaaaatcctccgtagagcagaatttgtcaacccattgcattgctgactttgggggctgggtaattctgtttttgtgggggactggccactgcaggatgtttagtaacatccctggcctctaccactagattttagcggcacacctcaaccccaacaccacagctgtgacaagcaaaaatgtctccagatactgccaagtgtccaccaagggaccaagtcgctcctggttgagaaccactgctctagagaaacagcatctacctccctgagagtttacttccccctcctccctttcacttcagtgcccttggacaaatgtttatttctatttgcttcaacaaaacccactgttggacttagagaccaaaattctctagtagagaattttcctgctagagacaacatcagtgttgttagcgcctaagaatattgttttctctttggagatagccctgggacccagtcctcacccttggagcctttcttcttccccctctccccctctttctccttttcaccttcccttgcctctgaaatcaggtctgtttttctctgtagtttttggactcttgaaaaaaaagctatgtcacaaagctcgtgactcagcctttaaacaacatgaatcataagacctgcagtgaaagaacagccaaaagaaaacagggtgtggtttgaagccaggcctagtcacctgagaaagaacctcagctttttgttcctctgaaaacttctttctggaattcaagaaggaaaccttatacagagctttgatgttctgttcctttaaaccctcttttcagaaatttagaaatatccctcacagaaatctctactggaagtcactgaggtctcctgctaaactgaaaaatgacattttatttttattattcatttacatttcttggtaatgaattcattctctttgaaaatgtttaaaacgataggagttaaagtctgttttgaatactgcttagacctttcccataaatacctacagacacaggttgccaaagaaaacatagttttgtttttattctcattttaagtacagtatttaaataacataatgtttataattccaacaggaatgtagtcttttcctaatagcagggtattttttagtcggttctctctttttctatatatttattgaaagcttcaagggtaaaaattaaaaacaccctccccacatttatagaaatagagaatatttctagaagagtctagaaagaacagtggctagggaattgagtgcatgagggaggtttttcattataaactatagaaaacctgttttaagttttcatcacgttcatatattttaaaacatttttaaaatatgcctttggaaaaaaatttaagtatgctttttgaaaaaaggaaaaaatatgctggagaaatgacacagagatcacaaaataaaatatcaaaatgaaaaagatctgactggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattacgtctcctccaaatgtgtatcactttgcttctttgagtttgtatcttggatgccacattttttcacatccatcattctcccttttcttaaacggaagatgaatgtcagtgctacaccaaggcataataagatggctcccagaattaccaagtgagtcctttcatttggaggatgtgccagaggtagttctgggatgaccaattcagctgtatggttttcctcaggatctaatctcctaaaagtgcagtagaaaatctcattagttgttgtgttgattctcagtgtgctggtcacattgaaaagcttctcctctctcttggaattggtggtggtggtcttaccactcaggacttgatggtcactgcttgtccagatgacttcggccttggggtagccctcagcctgacatgtcagttcatgttcagaggtgactggatccacaaccaaaattctttggttgattttgttgtatggggcattgactttcacagtaattcgcttgtagtcggcaccaccatagctgatcatgcagcggtacacccctgcatcctgcaatttcacatctgtgatctgaagtgcagcatttcccagggagagctggtccttcaacagccgggccctctgtctgtagctactatgctgaaccttcaggtcttcctctccatgcacaaattgaataatgttcttatcctccatttcccaatagacaattagtgcagccaggtctaattgtttttctactgggaatttgcattcaattgtcatattgctaccatactctaccacatataggtccttgggaaccgtgacagtaaatgcgttcagcaaatgccagtaggtcatgaatataaagacagcaaatatcctcataggtccaggattctcctcgacgtcaccgcatgttagcagacttcctctgccctctccgcttcccatggcataaagccctacagcaactgtcgccaccagaaagctgagtgtaaggacccatcggagaagcggagcctgggagcgggtgttgagtgggggcttccctctgggagtctccacgggggcagaatcttgcactttgttgctggcccgctggcgaagccctggtgcccgtgaggggctctggtccttggtgtcatgggtcagcagctcctgcaactcctcaaagagctggatgttgagcaggaacgcagtcttggcctcttctatcaccctctgcctgactgcgggagtcatctccagggagttcatgcgggagcggtagagctgcttgaacttggtggcactggcaatgttggggaaggtgaagaaggccaggccctcgccagagctgggcaggtccagggctttctgggcaatctttttgagcacctggcccccagacaggtcacccaggtagcgggtgtaggcgtgggccaccagcagctcgggctctgtgcgccccacctcgtggagccgcttcacatagcgctgcatggctggtgtgtaggggatgacctcctgccagcggggcccgtaccagaaggccaggtcctgctccagggcagccttgcggtgcagctcttctgggaagtagacaggggcgaagactgggctctccttgttgcgctcaatctcctcctccagggccacatagatgtggtacagggaggccatcaccagcttgaagccgtctcgggtcacctggcccttctgaaagttcctcatgaactcagcattctctgcctgggtgtgcacctccttggtggcctccttcagggcctctgacaaatcctggggcatgctgtcgggttgcggacgctccataggcccggggttctcctcgacgtcaccggcctgtttcagtagtgagaaattggtggcgccgctgccgccatacatctgcttgaactgaaagcattcgttgcagtagccgttgcacttggcattgccaaaatgatcacaggcgggggcccggcaacgctgcttgggggggtcttcgggggcaggctcaccccggtgggccccagggcccatcctctggttgggatgctgacactccatgcagagctcctcgctgcggcaggccaggatgttcttgcaggaggcccgggcgcacttgggccttgaggtgctttgtgtggttcgaggcacatctctgcgctggctcgatctcagttgctcttctgtccttttggcctcatgaaatctctgattctgagcttcaatgaaacacttctggcagtatccttcaaacatggtgcttccaagggtgccgcattccctccccaggcacggaatggtgttctggaacctggacgctgtgggactgactttccctgaggcagcagcaaaatgtttgttttctctgtactcgatgaaacacagtgtgcaaaagcccttgttttctggagtcccaaaatacacgcagccggcttttctgcacttgctcgtccccgtcctgtccccaggagtccgtgcagcttgagacaggcagccagcaggggcgtcgtttccagctctgtggcaagaatgcggggaggggctccggacgagccgcgagggatctgacttggaacgctggtgacaggaaggagggaggctggtgctgaggctggaggaggcctctgctgtagtccttttgaagcaagtactgcagatcccattaaatgtcctggtaacatcctggaggcaggcttggcacttcccgggatccaagtgccttgtgtggtctggggcgtggctggcgtgaagttgccgggcgttgtggcaacgttcacaaaatccgttgtgctgcacattcagtgtgaaggggcagccggggctcctgcacttcatggcagtggtctcactgaacagaaaagggctgggtgctgtcggtggggccgaatgaggccccccagtggactcctcagggttccacgccaagggctcataggcttctccccgagaggccccgagcgccatgccagggagcccctcagggcccggcttggagttcagctttgggagtttgttttgattcttttgccgcctctctgagcactcatggcataaaggctgggtgttcacagacatgaagaaggggcagttgggcgtttcacattttacatccatgagagaaagctggggcacggaaggttccatgggattctgggcgtgcccctctctcctcccctgctcgctgttttcctgccatttcttgtactcatgctgaacaagttcaaagtaatcatctaccagattgatttcttttggtaagttagcttcatccaactttgcggcattgatgagatgagttgtgccatggtcccagccttggacggggatttctatcaccattaagtactcttttaagagcttctccttcatctcattttcaggatctgtcaaaaagtgaacttttaagtcttcaaatcttccccggtctctgttaacaagtggaacagctcggatttcaggcccactgtccttcagggtcaccaagggtacaaaatgatggctgtcatagccgagaacaatggggtatctgtagcattcctgggcaggccagtggagaggcaagtaaattccacccactttcaaaggggcgaaattggaacctgattccaaacttcttagcattttgtctgaaatgacaatgattggccttctgaggatgttgcaaaggacaaatatgtgtatttcttccagtgagttgtactgaagtccacttcgggccatgggtgtgtctgtggaagccattttgataagattgtcccattcatcattccagttccgagtatcatagcaaagccccgtttcaacaaattcctgagatttgagagactccagttgccagcggaatttaaagttgcgtgtgtctgtttccttgagcgtgctgaacagcgccttcctcagtaccaagtctgtgtcctgaacgccccacatgtactgagaagtggcatgcatgaggcaattgccgtcaccgttcgttttcagcgccacaagcttccggacttctcgacaccagttgagtttcttctggctttccagggtggcctggatgtttctgtcgatgagggctttgtggatgatctcccgaaactgaggacaaaactggcaagttctgaacatttccagtgtgtatcggtgcatggttttaaaatgatgaatgatcccattagtaggtttaaaaatgtcttctggagttctctcccgtatcttcacagctttccgcatattgctcaaatacaaagcctgaggaaggacttgttcagccatggtggcggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatggggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgactggcagtggagccaccaacttctcactccttaagcaggctggcgacgtggaggagaaccccgggcctatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctgataagctccctttcctgctttccaggaaaggttttttcatcctcagagcccaaagattgaatatggaaaaattatgaagtgttttgagcatctggcctctgcctaataaagacatttattttcattgcactggtgtatttaaattatttcactgtctcttactcagatgggcacatgggagggcaaaacactgaagacataaagaaatgaagggctagtcgagaccttgagaaaatatatcagtatcttggaccccatgacagcagtggttgtaaatagctgatgttatggaaaacaggctttgctccttagccttactctcccttaaagaattcaagttgcagcttgatttgggagttagatattgctaaattttatttaaataaattatgttatttaccctttcttgtaaatgtcttctttctctttaattatccagaatatcacttagattcattaagttcttctgcctaattacaccactgttttaagattttctttttgcattttactgtccccatttctctttctcccctgttctctttttatcctagttttctctgccatcttaaaagaactacaagaaagacagaaccttctgtgctggattcggaaaatgacatatgaattatgagtaatccttgttccttcttgcatcctaattctgaatctcagttcagttcacttcagtctctcagttatgtacgattctttgcaatcccatggactgcagcataccaggctcccctgtccatcaccaactcctggagcttgcttaaattcatgtccatcgagttggtgatgccattcaaccatttcatcctctgtcgtccccttcctctgctttcaatctttcccagcatcagggtcttttccagtgagtccgttcttcacatcaagtggccaaagtgttgaagtttcagcttcagcatcggtccttccaataaatattcaggacttatttcctttaggtttgactggtttcatctccttgcaccccaaggtactctcgagagtcttctccaacatcgcaatccgatggcatcaattctttggcagtcagctttctttatgatccaactctcacatccatacatggctactggaaaaaccatagctttgactagatggaactttgtcggccaagcaatgtctctgctttttaataagctgtctagctttttatagacagcttattatagcttgttatagcttttcttccaaggagcaagcatcttttaatttcatgtctgcagtcaccatatgcagtgactttggaggccaggaaaataaagtctgtcactatttccactgcttccatctctttgcaatcaagtgatgggaccggatgccatggtcttcattttttgactgttgagttttaagacagctttttaattctcttctttcactttcatgaagaggctgtttagttcctctttggtgtctgccataagggtgggtgtcatctgtatatatgaagttattgatatttctcctggcaaccttgattccagcttgtgcttcatccagccctgcatttctcatgatgtactctgcatagaagttaaataatcgaggtgacaatacgcagctttgacctatttctttccctgttctgaatccagttggggagatgctgaaagtaacacatctaacaagtgactgtaaatgagtgtattcaaggtttttatgagatcagataatgaagcccttggtatgaaatgggtagtaaagataagtagtacagacaattgtccaaaagacaagaagacaaaagtcagaaaagcaaaggatagcataggccaaatcactgatgaataatgtgtttgtgtattctgagaatttcaggtaaacagaaaaacaaatgaagcaaaactgcctgggatagaatagaatagatactatattttggtgtacactgtggacacattcttaaagttaaaaattcaccaagaagattccatctagacattactcacaagatatttgcactggtaatcagccacagaatgaggtgtccataggcattaaggaaagtggtagaaaagaagcacccagcgtagctcgggttagtgaaccgaggcacttcatgctgcatatttgtattgcacgtttcagtgtacatcgtgtttcacttcctatatctcgttggacacttcagtttgccatatgatatgtccagggggttcaggcacggaggaagggcctcggaagacctcggggggagaggggcaggcactgctgtgtattgatggggggattgtttgcactggttgatgatctctgaacaaccaagaagtacacaaggatctacctaactggacgtgctaagtaatttcactttggggattattctccagggagacgatccattgatagagaagtgaaaagcatcgagatgtgtctagtagttgtaggaagtctggggtgctttcctgatggggtgccctcagctggaaatagcccctccttcctttgacctgtcctgtggctatttgcagacattttattcctcttaccagactgtaagctctttgaggctggatttctgccttttgtctattcattcattcactcattcttctattcatgcattcaccaattccacaagtagttgttgcctgtaacatgtgccagagattgtaccaggcagatgggcatatctagataagcaaaagacatgatcctttctcttctggagctaacaatctactgggggcagagataatagcaaacaagtaaatatataatggttaaatagaaatttcgaatttggaacattctcatgaggaaaacagctaagatatggagggagagaagaagccagaaggtgacgggacgaggcagctggcacagccctaggcccaggaattcaacaggcatctactgagtggacccaacgcatgagaggacagtgccaagcaagcaactcaaatgtcccaccggttgggcatggccaggtagcctatgctgtgtctggacgtcctcctgctggtatagttattttaaaatcagaaggacagggaagggagcagtggttcacgcctgtaatcccagcaatttgggaggccaaggtgggtagatcacctgagattaggagttggagaccagcctggccaatatggtgaaaccccgtctctaccaaaaaaacaaaaattagctgagcctggtcatgcatgcctggaatcccaacaactcgggaggctgaggcaggagaatcgcttgaacccaggaggcggagattgcagtgagccaagattgtgccactgcactccagcttggttcccaatagaccccgcaggccctacaggttgtcttcccaacttgccccttgctccataccacccccctccaccccataatattatagaaggacacctagtcagacaaaatgatgcaacttaattttattaggacaaggctggtgggcactggagtggcaacttccagggccaggagaggcactggggaggggtcacagggatgccacccgggcagctataccatatctttccagaaatatgaaggcttgtgaaagataagcaagcctatgatggccactgtgaaaaggaccagggagaatagaaccatgaggaagacataggtggagtgggagagaggtgtggacaatggttgctcagctgggatcatgttggtcaggttcagcatgtagcccaaagtccagccggcgtcgctgccctggatcttgccaatgaaatggatgtgctcccaggaatcagctgtgaaatgatagccttgcagaaggagggagagaatgtaggtaccagaaaagcagtattcactcaggtacttctcctttactccagcgtaagatgtttttatctcctcccaaggctgagcacagaactttttcatcatctcagtcaccttttcctgagagactttctctgatgtcaagtttaaaaacttcatcacaaagtaaaaagctgaaaatgccccaaaatccccctggagtggtggcaagaaaatcccattgaaggcacactgggagtaagggcagtaactggtgttgaagagctccaggatgctttgatggcattgttgatagtttccaataccctggatttcaaactgctggaatggaagagtcatctcaaatctcttggtgcagggggtcttgtaaaggtcacttacgttcactaccttcttatatccaggatgaaagcatgggtccctgagaatttcattacttgcaacctgaatgtccttggccagtttctgccagagtgcctgatccttcccatagcacaagaagctatgtgtgtagacattgtagtccttgccatagaggcgaaattgcagagcattatctggggactcgatagtctggttttggggtacaaaagtgacttgtgtagaggctcccccaaggtccaaagctccaaaggtttcctgattattggtttcatatgggactatgctgaaccaccttgttttctgactgaatttgcccagcagatagttgatagtaatccagccataggcaccttcctcttggccagtaatgatcctggcaccctggaagtcaaaggggtagttgctgaggctcctctccaccacatccagaaccctgtctgccaactcttcactttccatcctgagcaaccgcatgcctgccgtggctcccaggtaaacgggtgtctcttggtgctgggaccttggaatcacttccctagctctttccatgcaatcagtcaggtaaatgcctatttcatttactttctgaacaaattttgagattccaggacctttaaccctgcattcttctacttgatgcaccacgcctgtgtcattctccttttctgctggccacttatagatgtataaacttgtgtgagaagaacccgcatccagcacaatcccatacttaacgttttctggcaatgctttgttctgggtcaaccccacagcaagcaaagctatcacagctatgatagaggagaagccaaggatggctaggatattcttggagcaaaatgtcttcacgttagactcctttgtatcttccataggtccagggttgctctcaacatctccagccaatttcaagagagcataattagtacactgtccgcttccgagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcataggcccaggattctcctccacgtcgccagcctgctttaacaggctaaaattggtggcgccactgccaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggctttcaggagcttcttggagacggtggtctccagaccactgttctcaggctgagtacagctggcactacagttaatcacctgggaccttccagactccaccaccagctgcttcgtccacgtgggtttctcgaacgcctccttgccagaccctggaagaccagagacactgggcagcaggtgtccccgcttccctgcccagtggaactgcccacggcaggccatctgatcaaggggtaggggtccaaggagaaaggccagggatggcccctctgcttctctccccttgttcagaacgtatggcctcaaatctagacccaggaggctgcccctgtccccaggctgtctccctgcctctggttgctgtccctccagctcgtgacctccagatgagtctttctcatgcacatcttctaaatccgtggagtgagaccttatttgaccttcatggcccagcccaaatgtcccctcatgaaggcctctctgaagtggaggcagcttgtgtcctctgagcccgcatggtcatgggttcgactctttcccccctccgcccttctcctgcaaatcctttttgagcatctcttgggtgccaggcactgttctaggctccggggacccagcaggacccaagcagacctcaccccacccttacagagctcacaaagtaaaggagacagaccataagcagcaaaataggcaggctgttgctggtggcaagtgactgggaagggaaatggggtgcgggtatcatgtgaaagagtgtggtcaacacaggcctcactgaaacaccgaggtttgtgcaaagacatgaaagaggttgggggagcctggcaggtgcctgcggtggggagggaaccgccagtgccaggacctcaggcagggaggagcccaggatggctggagctcagggaggaggaaggtgggggggcaggggggaggcgagtcaggaaggtcatgggaccactttgcaaatgactcacattcctgctgcctctcctttgctgcctctcccattttggagtttctagagggcagagcctgggtttcacatgtttcctttgtgctcagcacaatgctccccctgtgtgtggcatcaggccaagaaatgttccaggcacgaagacagagccctcggcgctcacctcccactcagtgatcaccagaaggtccttgatccccacctgctgggcctggcctgtgtcctgttggctcctgccacaccggcatgcccccacttagccctcagctagcagcatagaaagaaggggcaagagaggcagggaaagagaagttggcggggtttgtttgtttgttcgtttctttggctttttatggccacacccgtggcatatggaagttcccaggctaggggctgaatcggagctgtagccactggcctacaccacagccacgccagatctgagccatgtctgcaatatacacttcagctcaaggcaacaccagatctttaacccactgagtgaggccagggattgaacccacatcctcatggatactggtgggccttgttactgctgagtcacaataggaacttccaggaaagagagatttgaatcttgaatttgcccggtgccagtcgtgtggcgttgagcaaagtgctttctctctctgagcctcagtttcttcctctgggccaataatccctttcctgcagggttgtcatgaaagtacatggcaggtgtgctcagcacacggtggcattttccttcaagggccctttgaccccctcgaaggggtttcattttcactttgagtggacccagaaggtgatgccctctgctgccccctaggccacactggacaacaagctgggaactcccttcacctcccgagcatcccgcctagcccaccattcagtctccacgacctgccacatccacatgccatgaagctatggggcctgttgaactggatgcccaaaaggccaggacccccacccgctgcccggggtcatggggaagccaggctggaacagcctccggtacccatgatgggcagccgctgtgttcaaagcctccgcaacttccagccccgaagccaggggaacagacgacccaccctctgggctggcagacgcccagtcggaaaccccaggcgctggcttacctgggcagcagagcagggcgagaaaggccatgaacagtccccaggaatcaaaaggggactacttgagtggcacccacgggctggcaggaaagagctgaggaccgcctggcgagagatgggggcgcaggtcagggagtggtggccgggagccgcaatccggaacccccagccatctgtgtgccgatgaccacacttcctctcattatttgaggaagacgtggcgcccagggctcaggtctataagcaacaggcagaggaagctgggaaagagctgataagcagggataaccttgtcatcctggcatgctcccatcaggggacacatgtgacagtgctgcatgtgcacggaggacagtgatgcccacaagccccagatctggggagccccaaatcccaggggacacactgtcagggtcccctctgggaagggactatccaaagtcaggacccggccagggcatgcagtcaccatgactaagtgggcagagaaacccgggcaggaactgctggtgctttagtcaactgcctggcacaagtctgcttaaacctggacactccgctttcaatctcagccagcctctgactccctgatacaagacaacttgagggcggcactcccatcatggcgcagcggaaatgaatctgactaggaaccatgaggttgaggttcgatccctggccttgctcagtgggataaggatccggcgttgctgtggctgtggtgtaggccggcagctacagctccgattagacccctagcttggggacctccataaaaggacaaaagacaaaaaaaaaaaaaaaaaaaaagacaacttgagggaaacgcactcagcatagtccccagcagccccagcatagtccccagcaggcgcagacagaagtaactcggggaggcttcctgggctagcttagggtgcacccccactccagacagggggccttgatgggggggggtagggctgaggacttgcagtgtgtttctagagaggctttgtcaccactgagggcatccctggaaacagtgcgcaggtgaggggggattcgatggtccggggtcggggtggcgatccccccccagggagcttttcatcatgatacatccagtctccgaaggccccagttacacccagagcctcaggaccggcagggcctgggaggggcaggagaataggtctgcttgctttctcaggggtgcccctgcttggtccttttcaaagagacaccccagccttttaaggactcaggcctccattcctggattcagagggtgggatgaggtcatgcccttctcttcggctctgaggccaaaggccattgccattgtgtgcagctgtcaagtgctgccactgccaacctggatgcagggaagttcctggacagcactgggtgggcttcagaccatacagagagaagacggagaaaagggcagcgctctcaccccagaccagagatccgatgccacatgggcctgcaggaaacactcctccaagccaagctagaccctgaggaggtaaccccacgggctccgaataacaacatcgataacacagcagtaaacatttactgactacaggtcagacgctgttacaagcactccacaaatattagctaattaaccccaaactctatgtggtaagtactgttactgtccccatgttacagatggggaaactgaggcccaaagtgattaagtgacttgcccagggtcccgcacctgggagagaggtgactgccgaagcccatcacagcagaggcaagaggaggattctcaggggcctgatctccaggagaccctcgggagggaaaggcaagatggccagaggagacggctggggtcttccttgccaggaggggctgggggaaggagggtggcttatgcccagagagctccaaacagcttctggaaggcacagtgcctgtggatccctgctgcacatgcatctgggccagcctgactccatcccactggtgtccaagtgaggcttgagacccacaagtcctgcgccaaacccaccagcccctgctcctgcccatgacttcttcccatccccttgggtaggcccccttgaccagggtaccccaggcacgtgaacgtggctttgttactgcatttttatagcttatacatcgatctcccctcctgcccactggcctgtccacccgtgggggcagaagctgaatcttatgcactgcaatatccacctccgataccacactgccttgcacatggaggtgcttgataaataaatgttcaatcactagattagtgggtgggtggatggatggatgggtgagtgggtaggtgggtggacggacggatggacggatggatggatggttggatggttgggtaaacaaatgaatgaaagaaatgaataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatccataacttcgtataggatactttatacgaagttatgcgatcgcttaattaa

SEQ ID NO: 173 - DNA, 29729 bp, synthetic construct
  misc_feature 1..29729: note = 17M4 full contig
  source 1..29729: mol_type = other DNA
ggcgcgcctagggataacagggtaatataacttcgtatagcatacattatacgaacggtagctggagcagtttgtgttctgccacagaatgcaaatacataaatgtaagcaggaaaacggacagagtagagtccctagggcttctttttattttttctctcctaagctgcagattcccttttatggttatataactgatgatgacgcaagtcaaacctttcccgtccagctctcagatttcaccctttctcttggaaagaaaatgtttgctggtcactacgtagacactctcatgacgctgagttaagtcccatacaaggtggtgaccttcaggagagctgaatcctttggggaaaggaggaaaggcagacaggtaggctccagtccaatccccaacagcccaacacccaggccctttgtgagctcagcccatcacgtgctcttgcctgcccgccaatcctgccgtgttgctgggcctctgtcactcttccattggtgccagctctgaagccatcccttctggggcacctgcaaaggatggatcagtgggtggaaggaactgaaaatggatccaatgactcatcctgcttctggcatattctagcacattgcattctaggtcaagggattttaggttgtaggaacgtgacttggtacacgatccccgaatccaagtgggacatttagactttgggagcccttctcagcaaacagaaaagcagctctaacaaaaacaacaaaaatcctccgtagagcagaatttgtcaacccattgcattgctgactttgggggctgggtaattctgtttttgtgggggactggccactgcaggatgtttagtaacatccctggcctctaccactagattttagcggcacacctcaaccccaacaccacagctgtgacaagcaaaaatgtctccagatactgccaagtgtccaccaagggaccaagtcgctcctggttgagaaccactgctctagagaaacagcatctacctccctgagagtttacttccccctcctccctttcacttcagtgcccttggacaaatgtttatttctatttgcttcaacaaaacccactgttggacttagagaccaaaattctctagtagagaattttcctgctagagacaacatcagtgttgttagcgcctaagaatattgttttctctttggagatagccctgggacccagtcctcacccttggagcctttcttcttccccctctccccctctttctccttttcaccttcccttgcctctgaaatcaggtctgtttttctctgtagtttttggactcttgaaaaaaaagctatgtcacaaagctcgtgactcagcctttaaacaacatgaatcataagacctgcagtgaaagaacagccaaaagaaaacagggtgtggtttgaagccaggcctagtcacctgagaaagaacctcagctttttgttcctctgaaaacttctttctggaattcaagaaggaaaccttatacagagctttgatgttctgttcctttaaaccctcttttcagaaatttagaaatatccctcacagaaatctctactggaagtcactgaggtctcctgctaaactgaaaaatgacattttatttttattattcatttacatttcttggtaatgaattcattctctttgaaaatgtttaaaacgataggagttaaagtctgttttgaatactgcttagacctttcccataaatacctacagacacaggttgccaaagaaaacatagttttgtttttattctcattttaagtacagtatttaaataacataatgtttataattccaacaggaatgtagtcttttcctaatagcagggtattttttagtcggttctctctttttctatatatttattgaaagcttcaagggtaaaaattaaaaacaccctccccacatttatagaaatagagaatatttctagaagagtctagaaagaacagtggctagggaattgagtgcatgagggaggtttttcattataaactatagaaaacctgttttaagttttcatcacgttcatatattttaaaacatttttaaaatatgcctttggaaaaaaatttaagtatgctttttgaaaaaaggaaaaaatatgctggagaaatgacacagagatcacaaaataaaatatcaaaatgaaaaagatctgactggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactactataccatatctttccagaaatatgaaggcttgtgaaagataagcaagcctatgatggccactgtgaaaaggaccagggagaatagaaccatgaggaagacataggtggagtgggagagaggtgtggacaatggttgctcagctgggatcatgttggtcaggttcagcatgtagcccaaagtccagccggcgtcgctgccctggatcttgccaatgaaatggatgtgctcccaggaatcagctgtgaaatgatagccttgcagaaggagggagagaatgtaggtaccagaaaagcagtattcactcaggtacttctcctttactccagcgtaagatgtttttatctcctcccaaggctgagcacagaactttttcatcatctcagtcaccttttcctgagagactttctctgatgtcaagtttaaaaacttcatcacaaagtaaaaagctgaaaatgccccaaaatccccctggagtggtggcaagaaaatcccattgaaggcacactgggagtaagggcagtaactggtgttgaagagctccaggatgctttgatggcattgttgatagtttccaataccctggatttcaaactgctggaatggaagagtcatctcaaatctcttggtgcagggggtcttgtaaaggtcacttacgttcactaccttcttatatccaggatgaaagcatgggtccctgagaatttcattacttgcaacctgaatgtccttggccagtttctgccagagtgcctgatccttcccatagcacaagaagctatgtgtgtagacattgtagtccttgccatagaggcgaaattgcagagcattatctggggactcgatagtctggttttggggtacaaaagtgacttgtgtagaggctcccccaaggtccaaagctccaaaggtttcctgattattggtttcatatgggactatgctgaaccaccttgttttctgactgaatttgcccagcagatagttgatagtaatccagccataggcaccttcctcttggccagtaatgatcctggcaccctggaagtcaaaggggtagttgctgaggctcctctccaccacatccagaaccctgtctgccaactcttcactttccatcctgagcaaccgcatgcctgccgtggctcccaggtaaacgggtgtctcttggtgctgggaccttggaatcacttccctagctctttccatgcaatcagtcaggtaaatgcctatttcatttactttctgaacaaattttgagattccaggacctttaaccctgcattcttctacttgatgcaccacgcctgtgtcattctccttttctgctggccacttatagatgtataaacttgtgtgagaagaacccgcatccagcacaatcccatacttaacgttttctggcaatgctttgttctgggtcaaccccacagcaagcaaagctatcacagctatgatagaggagaagccaaggatggctaggatattcttggagcaaaatgtcttcacgttagactcctttgtatcttccataggtccagggttgctctcaacatctccagccaatttcaagagagcataattagtacactgtccgcttccgagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcataggcccaggattctcctccacgtcgccagcctgctttaacaggctaaaattggtggcgccactgccaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatggggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgactggcagtggagccaccaacttctcactccttaagcaggctggcgacgtggaggagaaccccgggcctatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctgatagcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgattatatggccacaaccatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggcggcagcggcgccaccaatttctcactactgaaacaggccggtgacgtcgaggagaaccccgggcctatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgggaagcggagagggcagaggaagtctgctaacatgcggtgacgtcgaggagaatcctggacctatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaataactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgaataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatccataacttcgtataggatactttatacgaagttatgcgatcgcttaattaa

SEQ ID NO: 174 - DNA, 29237 bp, synthetic construct
  misc_feature 1..29237: note = 15S5
  source 1..29237: mol_type = other DNA
ataacttcgtatagcatacattatacgaacggtataagctccctttcctgctttccaggaaaggttttttcatcctcagagcccaaagattgaatatggaaaaattatgaagtgttttgagcatctggcctctgcctaataaagacatttattttcattgcactggtgtatttaaattatttcactgtctcttactcagatgggcacatgggagggcaaaacactgaagacataaagaaatgaagggctagtcgagaccttgagaaaatatatcagtatcttggaccccatgacagcagtggttgtaaatagctgatgttatggaaaacaggctttgctccttagccttactctcccttaaagaattcaagttgcagcttgatttgggagttagatattgctaaattttatttaaataaattatgttatttaccctttcttgtaaatgtcttctttctctttaattatccagaatatcacttagattcattaagttcttctgcctaattacaccactgttttaagattttctttttgcattttactgtccccatttctctttctcccctgttctctttttatcctagttttctctgccatcttaaaagaactacaagaaagacagaaccttctgtgctggattcggaaaatgacatatgaattatgagtaatccttgttccttcttgcatcctaattctgaatctcagttcagttcacttcagtctctcagttatgtacgattctttgcaatcccatggactgcagcataccaggctcccctgtccatcaccaactcctggagcttgcttaaattcatgtccatcgagttggtgatgccattcaaccatttcatcctctgtcgtccccttcctctgctttcaatctttcccagcatcagggtcttttccagtgagtccgttcttcacatcaagtggccaaagtgttgaagtttcagcttcagcatcggtccttccaataaatattcaggacttatttcctttaggtttgactggtttcatctccttgcaccccaaggtactctcgagagtcttctccaacatcgcaatccgatggcatcaattctttggcagtcagctttctttatgatccaactctcacatccatacatggctactggaaaaaccatagctttgactagatggaactttgtcggccaagcaatgtctctgctttttaataagctgtctagctttttatagacagcttattatagcttgttatagcttttcttccaaggagcaagcatcttttaatttcatgtctgcagtcaccatatgcagtgactttggaggccaggaaaataaagtctgtcactatttccactgcttccatctctttgcaatcaagtgatgggaccggatgccatggtcttcattttttgactgttgagttttaagacagctttttaattctcttctttcactttcatgaagaggctgtttagttcctctttggtgtctgccataagggtgggtgtcatctgtatatatgaagttattgatatttctcctggcaaccttgattccagcttgtgcttcatccagccctgcatttctcatgatgtactctgcatagaagttaaataatcgaggtgacaatacgcagctttgacctatttctttccctgttctgaatccagttggggagatgctgaaagtaacacatctaacaagtgactgtaaatgagtgtattcaaggtttttatgagatcagataatgaagcccttggtatgaaatgggtagtaaagataagtagtacagacaattgtccaaaagacaagaagacaaaagtcagaaaagcaaaggatagcataggccaaatcactgatgaataatgtgtttgtgtattctgagaatttcaggtaaacagaaaaacaaatgaagcaaaactgcctgggatagaatagaatagatactatattttggtgtacactgtggacacattcttaaagttaaaaattcaccaagaagattccatctagacattactcacaagatatttgcactggtaatcagccacagaatgaggtgtccataggcattaaggaaagtggtagaaaagaagcacccagcgtagctcgggttagtgaaccgaggcacttcatgctgcatatttgtattgcacgtttcagtgtacatcgtgtttcacttcctatatctcgttggacacttcagtttgccatatgatatgtccagggggttcaggcacggaggaagggcctcggaagacctcggggggagaggggcaggcactgctgtgtattgatggggggattgtttgcactggttgatgatctctgaacaaccaagaagtacacaaggatctacctaactggacgtgctaagtaatttcactttggggattattctccagggagacgatccattgatagagaagtgaaaagcatcgagatgtgtctagtagttgtaggaagtctggggtgctttcctgatggggtgccctcagctggaaatagcccctccttcctttgacctgtcctgtggctatttgcagacattttattcctcttaccagactgtaagctctttgaggctggatttctgccttttgtctattcattcattcactcattcttctattcatgcattcaccaattccacaagtagttgttgcctgtaacatgtgccagagattgtaccaggcagatgggcatatctagataagcaaaagacatgatcctttctcttctggagctaacaatctactgggggcagagataatagcaaacaagtaaatatataatggttaaatagaaatttcgaatttggaacattctcatgaggaaaacagctaagatatggagggagagaagaagccagaaggtgacgggacgaggcagctggcacagccctaggcccaggaattcaacaggcatctactgagtggacccaacgcatgagaggacagtgccaagcaagcaactcaaatgtcccaccggttgggcatggccaggtagcctatgctgtgtctggacgtcctcctgctggtatagttattttaaaatcagaaggacagggaagggagcagtggttcacgcctgtaatcccagcaatttgggaggccaaggtgggtagatcacctgagattaggagttggagaccagcctggccaatatggtgaaaccccgtctctaccaaaaaaacaaaaattagctgagcctggtcatgcatgcctggaatcccaacaactcgggaggctgaggcaggagaatcgcttgaacccaggaggcggagattgcagtgagccaagattgtgccactgcactccagcttggttcccaatagaccccgcaggccctacaggttgtcttcccaacttgccccttgctccataccacccccctccaccccataatattatagaaggacacctagtcagacaaaatgatgcaacttaattttattaggacaaggctggtgggcactggagtggcaacttccagggccaggagaggcactggggaggggtcacagggatgccacccgggcagtcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcatagggtcattaattgtaaaggaaaggtgccgacctccggtcacctattcaggcatagaagctttttaaaccgagcgcttttatagaagccccagtccccttctcagatcccgagtgtcgcgtgttacctcggggtacctgaagggcatccttagcctgtcaccagtgtgtgggtaccagtttcaatgtcactttaaagtgggtttcgcagtaaagtcgccgtgctggggttgcacacatgacgggcccgtgtgggcgtggcttttggccccgtgggtccttgttaccaaggaggagttcccacggccgtcatgctccgctacgaagcaacagtgctgttactaacactcgccagtggatcgagcgtggagccaaacacagtacaaagtgttacccctctagacctggaaagaccaggcggagtttcaagttgcacgttttgtgtcagttggggaaacctgcttattaacatcgccgtccacctgtgcacaggaagatgcctacagccacaccagcaatgatgaaactgcccaccaggacgcccaggaccagcgaagtgtaggagcggcttgtttggctccctttcgtgttttccgcggaaatatgtttctgcacatactgcacacaggtgtcctccaggaattcccgcagttcataccgagtgcggttgtaggcattgagctgctgcagggtgaaggtgaccactccggaggtgacctgggtgtctgcctgccacaaggctctctccggccggaaactcacaaaggagctcccattcacagccacttcgaagaagacatgggctctagagccctcgggaggcagctcacagcccaggaagcagcggatggtcagaggaaaggccaaggtccgctcctggtgcaccaggcgcacgaggccgtggaactggagcaggtaggactgcaggccactctgcgtgcgcgcccagctctcgggctcctgcaagggctgcagctgaatgatcgtggtgttggtgtctgggccttccagcacgtgcgttaggtgtccccccagcgacgcgttgccctggtaccacacgtgataggggtcgcggaagtaggagatctggagcatatgaagtctttggaggccatctgaggcgtcttggctacaaaaggcccagccagacagcagcagtatcggcagcaatgttgtcaacataggtccagggttctcctccacgtctccagcctgcttcagcaggctgaagttagtagctccgcttccgttattcctaggaggttgtatagtcttctgattggaagccacaaatttcatataaactagtccaagtaattgtgctagagctaagatactcaaacctgaaatcagaagagggccatgcattggtatacacgccgcaatacagagactcagtccaaccacagcgaggatataggctatcacctgaataaccaatatggcaatgacgaaggaggttaatccaatcgctgtactaaacacatagtagtgaagtaatattaatatccctgtagaagtcacaattaaaccaaggccagtagcattctttaatgaatattcacctgggacgaaaagaatggctccaacaatgacaatgacagtgatcactagtccagcaacaagtaaagcaattgttttctcatccataccaccggatctatatttaagtgttttaataccaaactgtccccagaacaggagtatagcaaaaattgggaaaataacaataagaatattttcatttggagaaaaccatgaaacaacacgatattttagctcgatgatcgtttcaccttctctggttaattctgttacttcacaagtgtagtttcctgtgtgtgagacagcatcactcttatccatcttcaaagaggcatctccttttagtaattgtgagacttcaatttttgcactactaaagtcagtggggacagtggacttgtttagagctccatcaaaggtgtaaatatctcttcctttaaatttccactttacgtatacttcagtagtgttttgtgcctccatattagtaacaaagcatggaatgacgacagtgtcattacaaaacgtgaattctacagattttgttttattaaatagtagctgagctgatccgcagcacgccgagcccagcaacagcgccgctaccaggggccacatggtggctgtctgttacaacacaaaaacaacaggaaaaaaaaaagcccaaagttcagcaagaaattcacaggccaatatatacccagtgctaaataattcattatcactttgtagtagccaaataactgacgtgcctaaaaacctcacaggcttgacaattaacctcaaatccaacgtctcaggcgtttaagaaagcaaaacatggaaacctgacccaggtaaattcgcggacctacttatcctccccctcaatggatgtctgtcctctgtcaacacggcagcgtttaccccaggcccaaaccctgtgtccccaaactactaaacatcttcctacacacatagcggcaggtggccccaccctaggctatgagcccacaaaaaggggtgaggcctcgtcacggtcgtggatcgcaagtcccctgccccagaagcgttcaggccaactcagcggcaccagcagttagtgtcccttcacagggacggaaaaccgaagttctcgccgcgcgccagccagccagtcgagccggaaagcaatgacctagcattcgatccccgaaacactgcacaaccccgttccacaaacggccgggccccgccatcaatggaagcctccgcgcctctcgtttccgtttcacccagtgctcctcgcccgcccccaatttctctctcccacctcagagcccgcttcagaggccggcttctcccacagagagattgggaacggccgccattttgctctaggtggccgttcgtcttaaggctattccgcacgagggccccgggtgactaagcagctcggctgcccttccgccgcggcgggcaagcagacctcccgcacccacccccgcagccgcaagacccccggacgtccgcctcaccaggtggcagtggcaacagcggtcacagaagaaacgcaggcaaactcccggcctccacgaaactgcctgcgccacacccggtgcttccttatatagccatcggtagcaccgccccagtagattcctccgcagaaacgccgagaagggactacttttcgcggcccttcctgccctctgaagagagaagcagtccccccagaatcttctaatttcactcctagaatgctttcctgtgaagactcgaacactggggctgattttgggggggggggacgaggccttagtcctgagcggccgagcggagggatcagcgtgttcgctgaacactgcgtccgcggacagggccggtactcggctggttggggggggtgtgggggaggtgccgcggaaggtgcgaaaacccgacacggagtcctctgagcgtccggagggggctgtccccgctgccggtccccggcgccccctcccctcaaccaggaaggctcgcctttcctgagacccgccctcggctaacaggggtcccgccgagcgcctcacgatgaatcggggtcccgctcccctggcccgagttccgccgtgcccctccccccaacccctcttccccgccagcgaaaccgtggggtctttattctgggtctcccataggtaacgatagtgtttctgtttccataaacttcccctcacccccagtgggtcgcgaggacttcccggggggtctagtcaccccaactgtggcggccgaacccatccccctgcgggcgggcaccgggacaagaggaatgactcgacaaatctcggggccgggcctcaagcccgcctcaggagggtcgtcaggacctgcaggaattttctcacaacgcaggagtgaaaaataagtgtccaaaggagaaatgcctgtgacaagttcacattgaattttgaaaagtaaaagcaaaaattccacacagctgtgaaacactccttgcgctggacctgaaagctgacagaactttgcggattgctcttcggccttcctgttttgttcccgattatgagcaagaaggcatcagaatttcacttctgctgccatttgaactcagaaatcagaaatcaaatctatttaaacccacgttttctttttttcttttttttaattttattttttaatgaagttttttattgtagttgatttataatgtcaatttctgctttacagcaaaatgatagtcatgcatatatatacatttcctttcttatcgctgagcctgagatttttaaaaggacactaattgtaagttctgtatagtcctggtggaaaaaagaccccaagtatgaaatttaaatctatagacaaattccatttggataaaagaaaaagatcaccagtcagatctttttcattttgatattttattttgtgatctctgtgtcatttctccagcatattttttccttttttcaaaaagcatacttaaatttttttccaaaggcatattttaaaaatgttttaaaatatatgaacgtgatgaaaacttaaaacaggttttctatagtttataatgaaaaacctccctcatgcactcaattccctagccactgttctttctagactcttctagaaatattctctatttctataaatgtggggagggtgtttttaatttttacccttgaagctttcaataaatatatagaaaaagagagaaccgactaaaaaataccctgctattaggaaaagactacattcctgttggaattataaacattatgttatttaaatactgtacttaaaatgagaataaaaacaaaactatgttttctttggcaacctgtgtctgtaggtatttatgggaaaggtctaagcagtattcaaaacagactttaactcctatcgttttaaacattttcaaagagaatgaattcattaccaagaaatgtaaatgaataataaaaataaaatgtcatttttcagtttagcaggagacctcagtgacttccagtagagatttctgtgagggatatttctaaatttctgaaaagagggtttaaaggaacagaacatcaaagctctgtataaggtttccttcttgaattccagaaagaagttttcagaggaacaaaaagctgaggttctttctcaggtgactaggcctggcttcaaaccacaccctgttttcttttggctgttctttcactgcaggtcttatgattcatgttgtttaaaggctgagtcacgagctttgtgacatagcttttttttcaagagtccaaaaactacagagaaaaacagacctgatttcagaggcaagggaaggtgaaaaggagaaagagggggagagggggaagaagaaaggctccaagggtgaggactgggtcccagggctatctccaaagagaaaacaatattcttaggcgctaacaacactgatgttgtctctagcaggaaaattctctactagagaattttggtctctaagtccaacagtgggttttgttgaagcaaatagaaataaacatttgtccaagggcactgaagtgaaagggaggagggggaagtaaactctcagggaggtagatgctgtttctctagagcagtggttctcaaccaggagcgacttggtcccttggtggacacttggcagtatctggagacatttttgcttgtcacagctgtggtgttggggttgaggtgtgccgctaaaatctagtggtagaggccagggatgttactaaacatcctgcagtggccagtcccccacaaaaacagaattacccagcccccaaagtcagcaatgcaatgggttgacaaattctgctctacggaggatttttgttgtttttgttagagctgcttttctgtttgctgagaagggctcccaaagtctaaatgtcccacttggattcggggatcgtgtaccaagtcacgttcctacaacctaaaatcccttgacctagaatgcaatgtgctagaatatgccagaagcaggatgagtcattggatccattttcagttccttccacccactgatccatcctttgcaggtgccccagaagggatggcttcagagctggcaccaatggaagagtgacagaggcccagcaacacggcaggattggcgggcaggcaagagcacgtgatgggctgagctcacaaagggcctgggtgttgggctgttggggattggactggagcctacctgtctgcctttcctcctttccccaaaggattcagctctcctgaaggtcaccaccttgtatgggacttaactcagcgtcatgagagtgtctacgtagtgaccagcaaacattttctttccaagagaaagggtgaaatctgagagctggacgggaaaggtttgacttgcgtcatcatcagttatataaccataaaagggaatctgcagcttaggagagaaaaaataaaaagaagccctagggactctactctgtccgttttcctgcttacatttatgtatttgcattctgtggcagaacacaaactgctccagcgagttcactcagactcacgtccatcgagtccgtgatgccatccagccatctcatcctctgtcgtccccttctcctcctgcccccaatccctcccagcatcagagtcttttccaatgagtcaactcttcgcatgaggtggccaaagtactggagtttcagctttagcatcattccttccaaagaaatcccagggctgatctccttcagaatagactggttggatctccttgcagttcaagggactctcaagagtcttctccatcaccacagttcaaaagcatcaattcttcggtgctcagccttcttcacagtccaactctcacatccatacatgaccacaggaaaaaccatagccttgactagatggacctttgttggcaaagtaatgtctctgcttttgaatatgctatctaggttggtcataactttccttccaaggagtgagcgtctttgaatttcatggctgcagtcaccatctgcagtgattttggagcccaaaaaaataaagtctgacactgtttccactgtttccccatctatttcccatgaagtgatggggccggatgccatgatcttcgttttctgaatgttgagctttaagccaactttttcactcttcactttcactttcatcaagaggcttttgagttcctcttcactttctgccgtaagggtggtgtcatctgcatatctgaggttattgatatttctcccggcaatcttgattccagcttgtgtttcttccagtccagcgtttctcatgatgtactctgcatagaagttaaataaacagggtgacaatatacagccttgatgtactccttttcctatttggaaccagtctgttgttccatgtcctgttctaactgttgcttcctgacctgcatacaaatttctcaagaggcagatcaggtggtctggtattcgcatctctttcagaattttccacagtttattgtgatccacacagtcaaaggctttggcatagtcaataaagcagaaatagatgtttttctggaactctcttgctttttccatgatccagcggatattggcaatttgatctctggttcttctgccttttctaaaaccagcttgaacatcaggaagttcatggttcacatattgctgaagcctggcttggataattttaagcattactttactagcatgtgagatgagtgcaatttcaagtaatagataatagtatttgtgctcaatacatcaacttctaaaagaccttgagatttacaaataattctaaagtcaaatggggacattacagggatattgatttcagctgaatgtaagcgatactttattgaaacttgaggggtttaatagaataaattgccttgtgaatagtgattcccttgacaccagtgctacacgagtgagtatgacctgtgagagatactatagcgtaagaatcctaaattagaagaaattaggatgaccttgaggaggccctgtgcatacatgctaagtcacttcagtcatgtccgacttccagacccagggatcaaatccatgtcttctgtggctcctgcattgcaggtggattctttaccactgagccacctgggaagcccctgtggggccctcctaaatccaaaattccatgatttttatttatttattttggctgcactgggtcttggttgtagcatgtgggatctttttagctgcagcatgtgggatctagttccctgaccagggatcaaacccaggccccctgcatttggagcttggggtcttagccactgcaccatgaaggaactcccccaaagtccatgattttaaagtcagacaattaaagattgacctgaagcagagggatggtttctgagctaagaaatggagctccagggttctgattattccaactttcaaccactccccaagtatatttacattaactactaaatgtaagatatcccaagtgaatacacatgtgtgccatttggaataacattcattacagcatctaagaacttcctaaaagcttttaaggaagatttgctgattattttcattgtaaaagaattattgattttgtaacatcatgttttacaaatatggatagaaataacaaaacataagagaaaaaaaacagagagataaattaatctgcaattttagtcggagattttaaaactcatttttcagtacttaagggtgtaaataggcttcctccccaaaaatcatctttgttgttaatttcttaattttcattagaggacatcctccatattaattcaatattgttaaatgctttgatacttgttttctgtttctgaaatacttggaaattaagcaacataattctaaattgccatagttaaagaagaaatcccaaagaaatttggaaaatatttgaactcgaggataatgaaatcacaaaatatcaaaatttgtagcatgtagctaaagcactgattaaaagaaaacttatacctttaaatcttatatttgaaaagaataaagctctaaagtagtaatctaaaaatccacttaaagaatataggcttttaaagacaaaaacttaaagtgagtagtaaagtagaaataataaagttatgagcaaaatttaacagacaatagagttactttgaacactaagcattgatttatagatcactagttacttagccaaggtgcttgggtgactaaaaacaactttaaaactgccctttgaagtgcatttagaaagaaaaagaaacgttcaagccgccattagggaagcagagtgtgatttaattcctttggaaaaacacagagcaccccacagttccatgcaaaaatagctgaagcttctcgcgtgctgtaatgtgtcaataactttagaaacctcatttcatttactcctcacccaagccttatgaggcaatattattatctctattttgtaggtgagcaaactgggtctcggggaggttaagtaatttcttcctgagcataagttcaagtccaggtccttctgattctttcccttattccaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagctttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactatcacatggcataaagccccatggcgaccgttgccaccagaaagctgagtgtcaggacccatcggatgagcggcacctgggagaggacgctgagctgcggcttccccctgggggttgtcacgggagtggagtcttgcacccggctgccggccctcttgcggatgtcggatgcctgcgagggtctctggtccttagtgtcctgggtcagcagctcctgcacctcctcaaacagctgaatgttgagcaggaaggcggtcttggcttcttcgaggaccctctgcttgacctcgggggtcatctccagagtgttcattcgggagcggtacagctgcttgaacttggtggcgttggcgacattggggaaagtgaagaaggccaggccctccccggagctgggcaggtccagggccttctgagcaatcttcttgaggacctggcccccagacaggtcacccatgtagcgggtgtaggcgtgggccaccagcagctcgggctcgaagcgccccacctgctgcagtcgccgcacgtagcgcttggtggcctgcgtgtaggggatggcctcctgccagcggggcccataccagaaggccatgtcctgctccagggcggcccggcggtgcagctcttccgggaagtagaggggcgtgtagaccgggttctccttgttgtgctcaatctcctcctccagggcatcgtagatgtggtacaaggacgccatcaccagcttaaagccttctcgggtgacctcgcccttctgaaagttcttcatgaactcggcattctcagcctggacgtgcacctccttggtggcctccttcagggcctctgacaaatcctggggcatgctgttgggctgtgagtgctccataggcccggggttctcctcgacgtcaccggcctgtttcagtagtgagaaattggtggcgccgctgccgccatacatctgcttgaattgaaagcactcattgcagtagccgttacacttggcattgccgaaatggtcgcaggcgggggcccggcagcgctgcgtcgggggatcctctgggacgggctctggccgccgggcgccagggctcactcgttggccaaggggctggcactctatgcacagctcctggctgcagcaggccagcacgttcctgcaggtggcccgggcgcacttggacctggaagcgctctgggtggctcgcgacaagtctctgcgctggctcagcctcagctgctcttcagtcctttttgcttcatgaaatctctgattctgagcctcaatgaaacacttctgacagtatccttcaaacaccgtgcttccgagggcgccacattccctgcccaggcaggggacggcattctggaacctggaggccgtgggactggctttccccgaggcagtgacgaaatgtttattttctctgtactcaatgaaacacagcgtgcaaaagcctttgttttccggagtcccaaagtacatgcagccggcttttctgcacttgctcgtccccgtcctgtcccccggagtccgtgcggccgaggcggagcagccagagggagcctcaggcccggctctgcggcaggggtgtggggagacgctctgggccagttgcgaggggtcggacttggagcgctggtggcaggatagggggatgctggagccgaggctggaggcgggctcagccgtagtccttttaaagcaagtgctgcagatcccgttaaacgtcctggtgacgttctggaggcaggcttggcacttgctggggtcgagatggcgcgtggggtccggggggtggccggggttgagctgccgggcgttgtggcatcgctcgcagaagccgttgtgctgcacgttgagcgtgaaggggcagccggggctcctgcacttcatggccgtagtctcgctgaacaggaagaggctgggagccgtcggaggggctgagcgggggcccccagagggctcctcggggttccaggcctccccgcgggaggctccaagcgccaggccgggcagcgcctcggggtccggcttggaggtgggctttgggggtttgctttggttcttctgccgtctctctgagcactcgtggcacaagggctgggtgttcaccgacatgaagaaagggcagttgggcgtctcgcacttgatgtccatgagagaaagctggggcacggaaggctccagagggttctgagggtgcgtggctctccgcccctgctcattgttttcctgccacttcttgtactcatgctggacaagttcgaagtaatcgtctaccaggtttatttctttgggtaagttagcttcatccaactttgcagcattaattagatgggtggtgccatggtcccagccttgaacggggatttctatcaccgtcaagtactctttcaggagcttttccttcatctcattttcgggatctgtcaagaagtgaacttttaagtcttcgaatcttcctcgctctctgttaacaagtggaatagctcggatttctggcccactgtccttcagggtcaccagggggacaaagtgttggctgtcgtagccgagaacgatagggtatctgtagcattcctgggcgggccaatgcagaggcaagtaaattccgcccaccttcagaggagcgaaattagaacccgattccaaacttctcagcatcttgtctgaaatgacgatgattggcctcctgaggatgttgcaaaggacgaatatgtgtatttcttccagtgaattatactgaagtccacttcgggccactggtgtgtccgtggatgccattttgataaggttgtcccattcctcagtccaattccgggtgtcatagcaaagccccgtttccacgaattcctgagatttaagggactccagctgccagcgaaatttgaagttgcgtgtgtccgtctccttgagggtgctgaagagcgccttcctcagcaccaagtctgtgtcctgaacaccccacatgtactgggaagcagcatgcatgaggcagttcccgtccccattcgttttcagtgccacaagcttcctcacttctcgacaccagttgagcttcttctggctttccagggaggcctggatgttcctgtcgatgagagctttgtggatgatctcccgaaattgcggacaaaactggcaggttctgaacatttccagagtgtatcggtgcatggatttaaaatggtgaatgattccattggtaggtttgaaaatatcttctggagttctctctcttatcttcacagccttccgcatgttgctcaaatacaaagccaggggaaggagttgctcagccatggtggcggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatggggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgttaagtgccgcggtcgtcggcgcctccgccctcccccttgggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagcccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggctgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatccataacttcgtataggatactttatacgaagttat

SEQ ID NO: 175 - DNA, 33461 bp, synthetic construct
  misc_feature 1..33461: note = 15S6
  source 1..33461: mol_type = other DNA
ataacttcgtatagcatacattatacgaacggtataagctccctttcctgctttccaggaaaggttttttcatcctcagagcccaaagattgaatatggaaaaattatgaagtgttttgagcatctggcctctgcctaataaagacatttattttcattgcactggtgtatttaaattatttcactgtctcttactcagatgggcacatgggagggcaaaacactgaagacataaagaaatgaagggctagtcgagaccttgagaaaatatatcagtatcttggaccccatgacagcagtggttgtaaatagctgatgttatggaaaacaggctttgctccttagccttactctcccttaaagaattcaagttgcagcttgatttgggagttagatattgctaaattttatttaaataaattatgttatttaccctttcttgtaaatgtcttctttctctttaattatccagaatatcacttagattcattaagttcttctgcctaattacaccactgttttaagattttctttttgcattttactgtccccatttctctttctcccctgttctctttttatcctagttttctctgccatcttaaaagaactacaagaaagacagaaccttctgtgctggattcggaaaatgacatatgaattatgagtaatccttgttccttcttgcatcctaattctgaatctcagttcagttcacttcagtctctcagttatgtacgattctttgcaatcccatggactgcagcataccaggctcccctgtccatcaccaactcctggagcttgcttaaattcatgtccatcgagttggtgatgccattcaaccatttcatcctctgtcgtccccttcctctgctttcaatctttcccagcatcagggtcttttccagtgagtccgttcttcacatcaagtggccaaagtgttgaagtttcagcttcagcatcggtccttccaataaatattcaggacttatttcctttaggtttgactggtttcatctccttgcaccccaaggtactctcgagagtcttctccaacatcgcaatccgatggcatcaattctttggcagtcagctttctttatgatccaactctcacatccatacatggctactggaaaaaccatagctttgactagatggaactttgtcggccaagcaatgtctctgctttttaataagctgtctagctttttatagacagcttattatagcttgttatagcttttcttccaaggagcaagcatcttttaatttcatgtctgcagtcaccatatgcagtgactttggaggccaggaaaataaagtctgtcactatttccactgcttccatctctttgcaatcaagtgatgggaccggatgccatggtcttcattttttgactgttgagttttaagacagctttttaattctcttctttcactttcatgaagaggctgtttagttcctctttggtgtctgccataagggtgggtgtcatctgtatatatgaagttattgatatttctcctggcaaccttgattccagcttgtgcttcatccagccctgcatttctcatgatgtactctgcatagaagttaaataatcgaggtgacaatacgcagctttgacctatttctttccctgttctgaatccagttggggagatgctgaaagtaacacatctaacaagtgactgtaaatgagtgtattcaaggtttttatgagatcagataatgaagcccttggtatgaaatgggtagtaaagataagtagtacagacaattgtccaaaagacaagaagacaaaagtcagaaaagcaaaggatagcataggccaaatcactgatgaataatgtgtttgtgtattctgagaatttcaggtaaacagaaaaacaaatgaagcaaaactgcctgggatagaatagaatagatactatattttggtgtacactgtggacacattcttaaagttaaaaattcaccaagaagattccatctagacattactcacaagatatttgcactggtaatcagccacagaatgaggtgtccataggcattaaggaaagtggtagaaaagaagcacccagcgtagctcgggttagtgaaccgaggcacttcatgctgcatatttgtattgcacgtttcagtgtacatcgtgtttcacttcctatatctcgttggacacttcagtttgccatatgatatgtccagggggttcaggcacggaggaagggcctcggaagacctcggggggagaggggcaggcactgctgtgtattgatggggggattgtttgcactggttgatgatctctgaacaaccaagaagtacacaaggatctacctaactggacgtgctaagtaatttcactttggggattattctccagggagacgatccattgatagagaagtgaaaagcatcgagatgtgtctagtagttgtaggaagtctggggtgctttcctgatggggtgccctcagctggaaatagcccctccttcctttgacctgtcctgtggctatttgcagacattttattcctcttaccagactgtaagctctttgaggctggatttctgccttttgtctattcattcattcactcattcttctattcatgcattcaccaattccacaagtagttgttgcctgtaacatgtgccagagattgtaccaggcagatgggcatatctagataagcaaaagacatgatcctttctcttctggagctaacaatctactgggggcagagataatagcaaacaagtaaatatataatggttaaatagaaatttcgaatttggaacattctcatgaggaaaacagctaagatatggagggagagaagaagccagaaggtgacgggacgaggcagctggcacagccctaggcccaggaattcaacaggcatctactgagtggacccaacgcatgagaggacagtgccaagcaagcaactcaaatgtcccaccggttgggcatggccaggtagcctatgctgtgtctggacgtcctcctgctggtatagttattttaaaatcagaaggacagggaagggagcagtggttcacgcctgtaatcccagcaatttgggaggccaaggtgggtagatcacctgagattaggagttggagaccagcctggccaatatggtgaaaccccgtctctaccaaaaaaacaaaaattagctgagcctggtcatgcatgcctggaatcccaacaactcgggaggctgaggcaggagaatcgcttgaacccaggaggcggagattgcagtgagccaagattgtgccactgcactccagcttggttcccaatagaccccgcaggccctacaggttgtcttcccaacttgccccttgctccataccacccccctccaccccataatattatagaaggacacctagtcagacaaaatgatgcaacttaattttattaggacaaggctggtgggcactggagtggcaacttccagggccaggagaggcactggggaggggtcacagggatgccacccgggcagtcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcatagggtcattaattgtaaaggaaaggtgccgacctccggtcacctattcaggcatagaagctttttaaaccgagcgcttttatagaagccccagtccccttctcagatcccgagtgtcgcgtgttacctcggggtacctgaagggcatccttagcctgtcaccagtgtgtgggtaccagtttcaatgtcactttaaagtgggtttcgcagtaaagtcgccgtgctggggttgcacacatgacgggcccgtgtgggcgtggcttttggccccgtgggtccttgttaccaaggaggagttcccacggccgtcatgctccgctacgaagcaacagtgctgttactaacactcgccagtggatcgagcgtggagccaaacacagtacaaagtgttacccctctagacctggaaagaccaggcggagtttcaagttgcacgttttgtgtcagttggggaaacctgcttattaacatcgccgtccacctgtgcacaggaagatgcctacagccacaccagcaatgatgaaactgcccaccaggacgcccaggaccagcgaagtgtaggagcggcttgtttggctccctttcgtgttttccgcggaaatatgtttctgcacatactgcacacaggtgtcctccaggaattcccgcagttcataccgagtgcggttgtaggcattgagctgctgcagggtgaaggtgaccactccggaggtgacctgggtgtctgcctgccacaaggctctctccggccggaaactcacaaaggagctcccattcacagccacttcgaagaagacatgggctctagagccctcgggaggcagctcacagcccaggaagcagcggatggtcagaggaaaggccaaggtccgctcctggtgcaccaggcgcacgaggccgtggaactggagcaggtaggactgcaggccactctgcgtgcgcgcccagctctcgggctcctgcaagggctgcagctgaatgatcgtggtgttggtgtctgggccttccagcacgtgcgttaggtgtccccccagcgacgcgttgccctggtaccacacgtgataggggtcgcggaagtaggagatctggagcatatgaagtctttggaggccatctgaggcgtcttggctacaaaaggcccagccagacagcagcagtatcggcagcaatgttgtcaacataggtccagggttctcctccacgtctccagcctgcttcagcaggctgaagttagtagctccgcttccgttattcctaggaggttgtatagtcttctgattggaagccacaaatttcatataaactagtccaagtaattgtgctagagctaagatactcaaacctgaaatcagaagagggccatgcattggtatacacgccgcaatacagagactcagtccaaccacagcgaggatataggctatcacctgaataaccaatatggcaatgacgaaggaggttaatccaatcgctgtactaaacacatagtagtgaagtaatattaatatccctgtagaagtcacaattaaaccaaggccagtagcattctttaatgaatattcacctgggacgaaaagaatggctccaacaatgacaatgacagtgatcactagtccagcaacaagtaaagcaattgttttctcatccataccaccggatctatatttaagtgttttaataccaaactgtccccagaacaggagtatagcaaaaattgggaaaataacaataagaatattttcatttggagaaaaccatgaaacaacacgatattttagctcgatgatcgtttcaccttctctggttaattctgttacttcacaagtgtagtttcctgtgtgtgagacagcatcactcttatccatcttcaaagaggcatctccttttagtaattgtgagacttcaatttttgcactactaaagtcagtggggacagtggacttgtttagagctccatcaaaggtgtaaatatctcttcctttaaatttccactttacgtatacttcagtagtgttttgtgcctccatattagtaacaaagcatggaatgacgacagtgtcattacaaaacgtgaattctacagattttgttttattaaatagtagctgagctgatccgcagcacgccgagcccagcaacagcgccgctaccaggggccacatggtggctgtctgttacaacacaaaaacaacaggaaaaaaaaaagcccaaagttcagcaagaaattcacaggccaatatatacccagtgctaaataattcattatcactttgtagtagccaaataactgacgtgcctaaaaacctcacaggcttgacaattaacctcaaatccaacgtctcaggcgtttaagaaagcaaaacatggaaacctgacccaggtaaattcgcggacctacttatcctccccctcaatggatgtctgtcctctgtcaacacggcagcgtttaccccaggcccaaaccctgtgtccccaaactactaaacatcttcctacacacatagcggcaggtggccccaccctaggctatgagcccacaaaaaggggtgaggcctcgtcacggtcgtggatcgcaagtcccctgccccagaagcgttcaggccaactcagcggcaccagcagttagtgtcccttcacagggacggaaaaccgaagttctcgccgcgcgccagccagccagtcgagccggaaagcaatgacctagcattcgatccccgaaacactgcacaaccccgttccacaaacggccgggccccgccatcaatggaagcctccgcgcctctcgtttccgtttcacccagtgctcctcgcccgcccccaatttctctctcccacctcagagcccgcttcagaggccggcttctcccacagagagattgggaacggccgccattttgctctaggtggccgttcgtcttaaggctattccgcacgagggccccgggtgactaagcagctcggctgcccttccgccgcggcgggcaagcagacctcccgcacccacccccgcagccgcaagacccccggacgtccgcctcaccaggtggcagtggcaacagcggtcacagaagaaacgcaggcaaactcccggcctccacgaaactgcctgcgccacacccggtgcttccttatatagccatcggtagcaccgccccagtagattcctccgcagaaacgccgagaagggactacttttcgcggcccttcctgccctctgaagagagaagcagtccccccagaatcttctaatttcactcctagaatgctttcctgtgaagactcgaacactggggctgattttgggggggggggacgaggccttagtcctgagcggccgagcggagggatcagcgtgttcgctgaacactgcgtccgcggacagggccggtactcggctggttggggggggtgtgggggaggtgccgcggaaggtgcgaaaacccgacacggagtcctctgagcgtccggagggggctgtccccgctgccggtccccggcgccccctcccctcaaccaggaaggctcgcctttcctgagacccgccctcggctaacaggggtcccgccgagcgcctcacgatgaatcggggtcccgctcccctggcccgagttccgccgtgcccctccccccaacccctcttccccgccagcgaaaccgtggggtctttattctgggtctcccataggtaacgatagtgtttctgtttccataaacttcccctcacccccagtgggtcgcgaggacttcccggggggtctagtcaccccaactgtggcggccgaacccatccccctgcgggcgggcaccgggacaagaggaatgactcgacaaatctcggggccgggcctcaagcccgcctcaggagggtcgtcaggacctgcaggaattttctcacaacgcaggagtgaaaaataagtgtccaaaggagaaatgcctgtgacaagttcacattgaattttgaaaagtaaaagcaaaaattccacacagctgtgaaacactccttgcgctggacctgaaagctgacagaactttgcggattgctcttcggccttcctgttttgttcccgattatgagcaagaaggcatcagaatttcacttctgctgccatttgaactcagaaatcagaaatcaaatctatttaaacccacgttttctttttttcttttttttaattttattttttaatgaagttttttattgtagttgatttataatgtcaatttctgctttacagcaaaatgatagtcatgcatatatatacatttcctttcttatcgctgagcctgagatttttaaaaggacactaattgtaagttctgtatagtcctggtggaaaaaagaccccaagtatgaaatttaaatctatagacaaattccatttggataaaagaaaaagatcaccagtcagatctttttcattttgatattttattttgtgatctctgtgtcatttctccagcatattttttccttttttcaaaaagcatacttaaatttttttccaaaggcatattttaaaaatgttttaaaatatatgaacgtgatgaaaacttaaaacaggttttctatagtttataatgaaaaacctccctcatgcactcaattccctagccactgttctttctagactcttctagaaatattctctatttctataaatgtggggagggtgtttttaatttttacccttgaagctttcaataaatatatagaaaaagagagaaccgactaaaaaataccctgctattaggaaaagactacattcctgttggaattataaacattatgttatttaaatactgtacttaaaatgagaataaaaacaaaactatgttttctttggcaacctgtgtctgtaggtatttatgggaaaggtctaagcagtattcaaaacagactttaactcctatcgttttaaacattttcaaagagaatgaattcattaccaagaaatgtaaatgaataataaaaataaaatgtcatttttcagtttagcaggagacctcagtgacttccagtagagatttctgtgagggatatttctaaatttctgaaaagagggtttaaaggaacagaacatcaaagctctgtataaggtttccttcttgaattccagaaagaagttttcagaggaacaaaaagctgaggttctttctcaggtgactaggcctggcttcaaaccacaccctgttttcttttggctgttctttcactgcaggtcttatgattcatgttgtttaaaggctgagtcacgagctttgtgacatagcttttttttcaagagtccaaaaactacagagaaaaacagacctgatttcagaggcaagggaaggtgaaaaggagaaagagggggagagggggaagaagaaaggctccaagggtgaggactgggtcccagggctatctccaaagagaaaacaatattcttaggcgctaacaacactgatgttgtctctagcaggaaaattctctactagagaattttggtctctaagtccaacagtgggttttgttgaagcaaatagaaataaacatttgtccaagggcactgaagtgaaagggaggagggggaagtaaactctcagggaggtagatgctgtttctctagagcagtggttctcaaccaggagcgacttggtcccttggtggacacttggcagtatctggagacatttttgcttgtcacagctgtggtgttggggttgaggtgtgccgctaaaatctagtggtagaggccagggatgttactaaacatcctgcagtggccagtcccccacaaaaacagaattacccagcccccaaagtcagcaatgcaatgggttgacaaattctgctctacggaggatttttgttgtttttgttagagctgcttttctgtttgctgagaagggctcccaaagtctaaatgtcccacttggattcggggatcgtgtaccaagtcacgttcctacaacctaaaatcccttgacctagaatgcaatgtgctagaatatgccagaagcaggatgagtcattggatccattttcagttccttccacccactgatccatcctttgcaggtgccccagaagggatggcttcagagctggcaccaatggaagagtgacagaggcccagcaacacggcaggattggcgggcaggcaagagcacgtgatgggctgagctcacaaagggcctgggtgttgggctgttggggattggactggagcctacctgtctgcctttcctcctttccccaaaggattcagctctcctgaaggtcaccaccttgtatgggacttaactcagcgtcatgagagtgtctacgtagtgaccagcaaacattttctttccaagagaaagggtgaaatctgagagctggacgggaaaggtttgacttgcgtcatcatcagttatataaccataaaagggaatctgcagcttaggagagaaaaaataaaaagaagccctagggactctactctgtccgttttcctgcttacatttatgtatttgcattctgtggcagaacacaaactgctccagcgagttcactcagactcacgtccatcgagtccgtgatgccatccagccatctcatcctctgtcgtccccttctcctcctgcccccaatccctcccagcatcagagtcttttccaatgagtcaactcttcgcatgaggtggccaaagtactggagtttcagctttagcatcattccttccaaagaaatcccagggctgatctccttcagaatagactggttggatctccttgcagttcaagggactctcaagagtcttctccatcaccacagttcaaaagcatcaattcttcggtgctcagccttcttcacagtccaactctcacatccatacatgaccacaggaaaaaccatagccttgactagatggacctttgttggcaaagtaatgtctctgcttttgaatatgctatctaggttggtcataactttccttccaaggagtgagcgtctttgaatttcatggctgcagtcaccatctgcagtgattttggagcccaaaaaaataaagtctgacactgtttccactgtttccccatctatttcccatgaagtgatggggccggatgccatgatcttcgttttctgaatgttgagctttaagccaactttttcactcttcactttcactttcatcaagaggcttttgagttcctcttcactttctgccgtaagggtggtgtcatctgcatatctgaggttattgatatttctcccggcaatcttgattccagcttgtgtttcttccagtccagcgtttctcatgatgtactctgcatagaagttaaataaacagggtgacaatatacagccttgatgtactccttttcctatttggaaccagtctgttgttccatgtcctgttctaactgttgcttcctgacctgcatacaaatttctcaagaggcagatcaggtggtctggtattcgcatctctttcagaattttccacagtttattgtgatccacacagtcaaaggctttggcatagtcaataaagcagaaatagatgtttttctggaactctcttgctttttccatgatccagcggatattggcaatttgatctctggttcttctgccttttctaaaaccagcttgaacatcaggaagttcatggttcacatattgctgaagcctggcttggataattttaagcattactttactagcatgtgagatgagtgcaatttcaagtaatagataatagtatttgtgctcaatacatcaacttctaaaagaccttgagatttacaaataattctaaagtcaaatggggacattacagggatattgatttcagctgaatgtaagcgatactttattgaaacttgaggggtttaatagaataaattgccttgtgaatagtgattcccttgacaccagtgctacacgagtgagtatgacctgtgagagatactatagcgtaagaatcctaaattagaagaaattaggatgaccttgaggaggccctgtgcatacatgctaagtcacttcagtcatgtccgacttccagacccagggatcaaatccatgtcttctgtggctcctgcattgcaggtggattctttaccactgagccacctgggaagcccctgtggggccctcctaaatccaaaattccatgatttttatttatttattttggctgcactgggtcttggttgtagcatgtgggatctttttagctgcagcatgtgggatctagttccctgaccagggatcaaacccaggccccctgcatttggagcttggggtcttagccactgcaccatgaaggaactcccccaaagtccatgattttaaagtcagacaattaaagattgacctgaagcagagggatggtttctgagctaagaaatggagctccagggttctgattattccaactttcaaccactccccaagtatatttacattaactactaaatgtaagatatcccaagtgaatacacatgtgtgccatttggaataacattcattacagcatctaagaacttcctaaaagcttttaaggaagatttgctgattattttcattgtaaaagaattattgattttgtaacatcatgttttacaaatatggatagaaataacaaaacataagagaaaaaaaacagagagataaattaatctgcaattttagtcggagattttaaaactcatttttcagtacttaagggtgtaaataggcttcctccccaaaaatcatctttgttgttaatttcttaattttcattagaggacatcctccatattaattcaatattgttaaatgctttgatacttgttttctgtttctgaaatacttggaaattaagcaacataattctaaattgccatagttaaagaagaaatcccaaagaaatttggaaaatatttgaactcgaggataatgaaatcacaaaatatcaaaatttgtagcatgtagctaaagcactgattaaaagaaaacttatacctttaaatcttatatttgaaaagaataaagctctaaagtagtaatctaaaaatccacttaaagaatataggcttttaaagacaaaaacttaaagtgagtagtaaagtagaaataataaagttatgagcaaaatttaacagacaatagagttactttgaacactaagcattgatttatagatcactagttacttagccaaggtgcttgggtgactaaaaacaactttaaaactgccctttgaagtgcatttagaaagaaaaagaaacgttcaagccgccattagggaagcagagtgtgatttaattcctttggaaaaacacagagcaccccacagttccatgcaaaaatagctgaagcttctcgcgtgctgtaatgtgtcaataactttagaaacctcatttcatttactcctcacccaagccttatgaggcaatattattatctctattttgtaggtgagcaaactgggtctcggggaggttaagtaatttcttcctgagcataagttcaagtccaggtccttctgattctttcccttattccaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagctttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactatcatttacccggagacagggagaggctcttctgcgtgtagtggttgtgcagagcctcatgcatcacggagcatgagaagacgttcccctgctgccacctgctcttgtccacggtgagcttgctgtagaggaagaaggagccgtcggagtccagcacgggaggcgtggtcttgtagttgttctccggctgcccattgctctcccactccacggcgatgtcgctgggatagaagcctttgaccaggcaggtcaggctgacctggttcttggtcagctcatcccgggatgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggggaagaggaagactgacgatccccccaggagttcaggtgctggggacggtggggatgtgtgagttttgtcagaagatttgggctcctgatcagaatctgggcacggttctggatcaattacataaatctgggttccgttgcctatgccctcgtagtatggcggtgggtacatgagctccaccttgcagatgtagagtcccgtgtccatggccctcagtccttggatagtgaggttcacttgatttccactggaggtgcccgtgcagatggaatcatctaggaaggtcaactcattccccatcatgtaggttgccgcacagacttcagtcacctggctgtcagcctgccgaagcactgtcacccggacctcagtatatttgcctggagatgcatactcacacacaaagctagcgatgcctcggctgctggccagtaccacagcaggctgggccacgtgcattgccatgctcgccatgcttggaaacaggagtgcaaggaccagactgagcagcgtcctctgtgtgagcagtacacccataggcccggggttctcctcgacgtcaccggcctgtttcagtagtgagaaattggtggcgccgctgccgccatacatctgcttgaattgaaagcactcattgcagtagccgttacacttggcattgccgaaatggtcgcaggcgggggcccggcagcgctgcgtcgggggatcctctgggacgggctctggccgccgggcgccagggctcactcgttggccaaggggctggcactctatgcacagctcctggctgcagcaggccagcacgttcctgcaggtggcccgggcgcacttggacctggaagcgctctgggtggctcgcgacaagtctctgcgctggctcagcctcagctgctcttcagtcctttttgcttcatgaaatctctgattctgagcctcaatgaaacacttctgacagtatccttcaaacaccgtgcttccgagggcgccacattccctgcccaggcaggggacggcattctggaacctggaggccgtgggactggctttccccgaggcagtgacgaaatgtttattttctctgtactcaatgaaacacagcgtgcaaaagcctttgttttccggagtcccaaagtacatgcagccggcttttctgcacttgctcgtccccgtcctgtcccccggagtccgtgcggccgaggcggagcagccagagggagcctcaggcccggctctgcggcaggggtgtggggagacgctctgggccagttgcgaggggtcggacttggagcgctggtggcaggatagggggatgctggagccgaggctggaggcgggctcagccgtagtccttttaaagcaagtgctgcagatcccgttaaacgtcctggtgacgttctggaggcaggcttggcacttgctggggtcgagatggcgcgtggggtccggggggtggccggggttgagctgccgggcgttgtggcatcgctcgcagaagccgttgtgctgcacgttgagcgtgaaggggcagccggggctcctgcacttcatggccgtagtctcgctgaacaggaagaggctgggagccgtcggaggggctgagcgggggcccccagagggctcctcggggttccaggcctccccgcgggaggctccaagcgccaggccgggcagcgcctcggggtccggcttggaggtgggctttgggggtttgctttggttcttctgccgtctctctgagcactcgtggcacaagggctgggtgttcaccgacatgaagaaagggcagttgggcgtctcgcacttgatgtccatgagagaaagctggggcacggaaggctccagagggttctgagggtgcgtggctctccgcccctgctcattgttttcctgccacttcttgtactcatgctggacaagttcgaagtaatcgtctaccaggtttatttctttgggtaagttagcttcatccaactttgcagcattaattagatgggtggtgccatggtcccagccttgaacggggatttctatcaccgtcaagtactctttcaggagcttttccttcatctcattttcgggatctgtcaagaagtgaacttttaagtcttcgaatcttcctcgctctctgttaacaagtggaatagctcggatttctggcccactgtccttcagggtcaccagggggacaaagtgttggctgtcgtagccgagaacgatagggtatctgtagcattcctgggcgggccaatgcagaggcaagtaaattccgcccaccttcagaggagcgaaattagaacccgattccaaacttctcagcatcttgtctgaaatgacgatgattggcctcctgaggatgttgcaaaggacgaatatgtgtatttcttccagtgaattatactgaagtccacttcgggccactggtgtgtccgtggatgccattttgataaggttgtcccattcctcagtccaattccgggtgtcatagcaaagccccgtttccacgaattcctgagatttaagggactccagctgccagcgaaatttgaagttgcgtgtgtccgtctccttgagggtgctgaagagcgccttcctcagcaccaagtctgtgtcctgaacaccccacatgtactgggaagcagcatgcatgaggcagttcccgtccccattcgttttcagtgccacaagcttcctcacttctcgacaccagttgagcttcttctggctttccagggaggcctggatgttcctgtcgatgagagctttgtggatgatctcccgaaattgcggacaaaactggcaggttctgaacatttccagagtgtatcggtgcatggatttaaaatggtgaatgattccattggtaggtttgaaaatatcttctggagttctctctcttatcttcacagccttccgcatgttgctcaaatacaaagccaggggaaggagttgctcagccatggtggcggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatggggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgttaagtgccgcggtcgtcggcgcctccgccctcccccttgggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagcccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggctgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatccataacttcgtataggatactttatacgaagttatcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaaccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttattttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagatgaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcag

SEQ ID NO: 176 - DNA, 28622 bp, synthetic construct
  misc_feature 1..28622: note = 17P1
  source 1..28622: mol_type = other DNA
ataacttcgtatagcatacattatacgaacggtataagctccctttcctgctttccaggaaaggttttttcatcctcagagcccaaagattgaatatggaaaaattatgaagtgttttgagcatctggcctctgcctaataaagacatttattttcattgcactggtgtatttaaattatttcactgtctcttactcagatgggcacatgggagggcaaaacactgaagacataaagaaatgaagggctagtcgagaccttgagaaaatatatcagtatcttggaccccatgacagcagtggttgtaaatagctgatgttatggaaaacaggctttgctccttagccttactctcccttaaagaattcaagttgcagcttgatttgggagttagatattgctaaattttatttaaataaattatgttatttaccctttcttgtaaatgtcttctttctctttaattatccagaatatcacttagattcattaagttcttctgcctaattacaccactgttttaagattttctttttgcattttactgtccccatttctctttctcccctgttctctttttatcctagttttctctgccatcttaaaagaactacaagaaagacagaaccttctgtgctggattcggaaaatgacatatgaattatgagtaatccttgttccttcttgcatcctaattctgaatctcagttcagttcacttcagtctctcagttatgtacgattctttgcaatcccatggactgcagcataccaggctcccctgtccatcaccaactcctggagcttgcttaaattcatgtccatcgagttggtgatgccattcaaccatttcatcctctgtcgtccccttcctctgctttcaatctttcccagcatcagggtcttttccagtgagtccgttcttcacatcaagtggccaaagtgttgaagtttcagcttcagcatcggtccttccaataaatattcaggacttatttcctttaggtttgactggtttcatctccttgcaccccaaggtactctcgagagtcttctccaacatcgcaatccgatggcatcaattctttggcagtcagctttctttatgatccaactctcacatccatacatggctactggaaaaaccatagctttgactagatggaactttgtcggccaagcaatgtctctgctttttaataagctgtctagctttttatagacagcttattatagcttgttatagcttttcttccaaggagcaagcatcttttaatttcatgtctgcagtcaccatatgcagtgactttggaggccaggaaaataaagtctgtcactatttccactgcttccatctctttgcaatcaagtgatgggaccggatgccatggtcttcattttttgactgttgagttttaagacagctttttaattctcttctttcactttcatgaagaggctgtttagttcctctttggtgtctgccataagggtgggtgtcatctgtatatatgaagttattgatatttctcctggcaaccttgattccagcttgtgcttcatccagccctgcatttctcatgatgtactctgcatagaagttaaataatcgaggtgacaatacgcagctttgacctatttctttccctgttctgaatccagttggggagatgctgaaagtaacacatctaacaagtgactgtaaatgagtgtattcaaggtttttatgagatcagataatgaagcccttggtatgaaatgggtagtaaagataagtagtacagacaattgtccaaaagacaagaagacaaaagtcagaaaagcaaaggatagcataggccaaatcactgatgaataatgtgtttgtgtattctgagaatttcaggtaaacagaaaaacaaatgaagcaaaactgcctgggatagaatagaatagatactatattttggtgtacactgtggacacattcttaaagttaaaaattcaccaagaagattccatctagacattactcacaagatatttgcactggtaatcagccacagaatgaggtgtccataggcattaaggaaagtggtagaaaagaagcacccagcgtagctcgggttagtgaaccgaggcacttcatgctgcatatttgtattgcacgtttcagtgtacatcgtgtttcacttcctatatctcgttggacacttcagtttgccatatgatatgtccagggggttcaggcacggaggaagggcctcggaagacctcggggggagaggggcaggcactgctgtgtattgatggggggattgtttgcactggttgatgatctctgaacaaccaagaagtacacaaggatctacctaactggacgtgctaagtaatttcactttggggattattctccagggagacgatccattgatagagaagtgaaaagcatcgagatgtgtctagtagttgtaggaagtctggggtgctttcctgatggggtgccctcagctggaaatagcccctccttcctttgacctgtcctgtggctatttgcagacattttattcctcttaccagactgtaagctctttgaggctggatttctgccttttgtctattcattcattcactcattcttctattcatgcattcaccaattccacaagtagttgttgcctgtaacatgtgccagagattgtaccaggcagatgggcatatctagataagcaaaagacatgatcctttctcttctggagctaacaatctactgggggcagagataatagcaaacaagtaaatatataatggttaaatagaaatttcgaatttggaacattctcatgaggaaaacagctaagatatggagggagagaagaagccagaaggtgacgggacgaggcagctggcacagccctaggcccaggaattcaacaggcatctactgagtggacccaacgcatgagaggacagtgccaagcaagcaactcaaatgtcccaccggttgggcatggccaggtagcctatgctgtgtctggacgtcctcctgctggtatagttattttaaaatcagaaggacagggaagggagcagtggttcacgcctgtaatcccagcaatttgggaggccaaggtgggtagatcacctgagattaggagttggagaccagcctggccaatatggtgaaaccccgtctctaccaaaaaaacaaaaattagctgagcctggtcatgcatgcctggaatcccaacaactcgggaggctgaggcaggagaatcgcttgaacccaggaggcggagattgcagtgagccaagattgtgccactgcactccagcttggttcccaatagaccccgcaggccctacaggttgtcttcccaacttgccccttgctccataccacccccctccaccccataatattatagaaggacacctagtcagacaaaatgatgcaacttaattttattaggacaaggctggtgggcactggagtggcaacttccagggccaggagaggcactggggaggggtcacagggatgccacccgggcagtcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcatagggtcattaattgtaaaggaaaggtgccgacctccggtcacctattcaggcatagaagctttttaaaccgagcgcttttatagaagccccagtccccttctcagatcccgagtgtcgcgtgttacctcggggtacctgaagggcatccttagcctgtcaccagtgtgtgggtaccagtttcaatgtcactttaaagtgggtttcgcagtaaagtcgccgtgctggggttgcacacatgacgggcccgtgtgggcgtggcttttggccccgtgggtccttgttaccaaggaggagttcccacggccgtcatgctccgctacgaagcaacagtgctgttactaacactcgccagtggatcgagcgtggagccaaacacagtacaaagtgttacccctctagacctggaaagaccaggcggagtttcaagttgcacgttttgtgtcagttggggaaacctgcttattaaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggctgtctgttacaacacaaaaacaacaggaaaaaaaaaagcccaaagttcagcaagaaattcacaggccaatatatacccagtgctaaataattcattatcactttgtagtagccaaataactgacgtgcctaaaaacctcacaggcttgacaattaacctcaaatccaacgtctcaggcgtttaagaaagcaaaacatggaaacctgacccaggtaaattcgcggacctacttatcctccccctcaatggatgtctgtcctctgtcaacacggcagcgtttaccccaggcccaaaccctgtgtccccaaactactaaacatcttcctacacacatagcggcaggtggccccaccctaggctatgagcccacaaaaaggggtgaggcctcgtcacggtcgtggatcgcaagtcccctgccccagaagcgttcaggccaactcagcggcaccagcagttagtgtcccttcacagggacggaaaaccgaagttctcgccgcgcgccagccagccagtcgagccggaaagcaatgacctagcattcgatccccgaaacactgcacaaccccgttccacaaacggccgggccccgccatcaatggaagcctccgcgcctctcgtttccgtttcacccagtgctcctcgcccgcccccaatttctctctcccacctcagagcccgcttcagaggccggcttctcccacagagagattgggaacggccgccattttgctctaggtggccgttcgtcttaaggctattccgcacgagggccccgggtgactaagcagctcggctgcccttccgccgcggcgggcaagcagacctcccgcacccacccccgcagccgcaagacccccggacgtccgcctcaccaggtggcagtggcaacagcggtcacagaagaaacgcaggcaaactcccggcctccacgaaactgcctgcgccacacccggtgcttccttatatagccatcggtagcaccgccccagtagattcctccgcagaaacgccgagaagggactacttttcgcggcccttcctgccctctgaagagagaagcagtccccccagaatcttctaatttcactcctagaatgctttcctgtgaagactcgaacactggggctgattttgggggggggggacgaggccttagtcctgagcggccgagcggagggatcagcgtgttcgctgaacactgcgtccgcggacagggccggtactcggctggttggggggggtgtgggggaggtgccgcggaaggtgcgaaaacccgacacggagtcctctgagcgtccggagggggctgtccccgctgccggtccccggcgccccctcccctcaaccaggaaggctcgcctttcctgagacccgccctcggctaacaggggtcccgccgagcgcctcacgatgaatcggggtcccgctcccctggcccgagttccgccgtgcccctccccccaacccctcttccccgccagcgaaaccgtggggtctttattctgggtctcccataggtaacgatagtgtttctgtttccataaacttcccctcacccccagtgggtcgcgaggacttcccggggggtctagtcaccccaactgtggcggccgaacccatccccctgcgggcgggcaccgggacaagaggaatgactcgacaaatctcggggccgggcctcaagcccgcctcaggagggtcgtcaggacctgcaggaattttctcacaacgcaggagtgaaaaataagtgtccaaaggagaaatgcctgtgacaagttcacattgaattttgaaaagtaaaagcaaaaattccacacagctgtgaaacactccttgcgctggacctgaaagctgacagaactttgcggattgctcttcggccttcctgttttgttcccgattatgagcaagaaggcatcagaatttcacttctgctgccatttgaactcagaaatcagaaatcaaatctatttaaacccacgttttctttttttcttttttttaattttattttttaatgaagttttttattgtagttgatttataatgtcaatttctgctttacagcaaaatgatagtcatgcatatatatacatttcctttcttatcgctgagcctgagatttttaaaaggacactaattgtaagttctgtatagtcctggtggaaaaaagaccccaagtatgaaatttaaatctatagacaaattccatttggataaaagaaaaagatcaccagtcagatctttttcattttgatattttattttgtgatctctgtgtcatttctccagcatattttttccttttttcaaaaagcatacttaaatttttttccaaaggcatattttaaaaatgttttaaaatatatgaacgtgatgaaaacttaaaacaggttttctatagtttataatgaaaaacctccctcatgcactcaattccctagccactgttctttctagactcttctagaaatattctctatttctataaatgtggggagggtgtttttaatttttacccttgaagctttcaataaatatatagaaaaagagagaaccgactaaaaaataccctgctattaggaaaagactacattcctgttggaattataaacattatgttatttaaatactgtacttaaaatgagaataaaaacaaaactatgttttctttggcaacctgtgtctgtaggtatttatgggaaaggtctaagcagtattcaaaacagactttaactcctatcgttttaaacattttcaaagagaatgaattcattaccaagaaatgtaaatgaataataaaaataaaatgtcatttttcagtttagcaggagacctcagtgacttccagtagagatttctgtgagggatatttctaaatttctgaaaagagggtttaaaggaacagaacatcaaagctctgtataaggtttccttcttgaattccagaaagaagttttcagaggaacaaaaagctgaggttctttctcaggtgactaggcctggcttcaaaccacaccctgttttcttttggctgttctttcactgcaggtcttatgattcatgttgtttaaaggctgagtcacgagctttgtgacatagcttttttttcaagagtccaaaaactacagagaaaaacagacctgatttcagaggcaagggaaggtgaaaaggagaaagagggggagagggggaagaagaaaggctccaagggtgaggactgggtcccagggctatctccaaagagaaaacaatattcttaggcgctaacaacactgatgttgtctctagcaggaaaattctctactagagaattttggtctctaagtccaacagtgggttttgttgaagcaaatagaaataaacatttgtccaagggcactgaagtgaaagggaggagggggaagtaaactctcagggaggtagatgctgtttctctagagcagtggttctcaaccaggagcgacttggtcccttggtggacacttggcagtatctggagacatttttgcttgtcacagctgtggtgttggggttgaggtgtgccgctaaaatctagtggtagaggccagggatgttactaaacatcctgcagtggccagtcccccacaaaaacagaattacccagcccccaaagtcagcaatgcaatgggttgacaaattctgctctacggaggatttttgttgtttttgttagagctgcttttctgtttgctgagaagggctcccaaagtctaaatgtcccacttggattcggggatcgtgtaccaagtcacgttcctacaacctaaaatcccttgacctagaatgcaatgtgctagaatatgccagaagcaggatgagtcattggatccattttcagttccttccacccactgatccatcctttgcaggtgccccagaagggatggcttcagagctggcaccaatggaagagtgacagaggcccagcaacacggcaggattggcgggcaggcaagagcacgtgatgggctgagctcacaaagggcctgggtgttgggctgttggggattggactggagcctacctgtctgcctttcctcctttccccaaaggattcagctctcctgaaggtcaccaccttgtatgggacttaactcagcgtcatgagagtgtctacgtagtgaccagcaaacattttctttccaagagaaagggtgaaatctgagagctggacgggaaaggtttgacttgcgtcatcatcagttatataaccataaaagggaatctgcagcttaggagagaaaaaataaaaagaagccctagggactctactctgtccgttttcctgcttacatttatgtatttgcattctgtggcagaacacaaactgctccagcgagttcactcagactcacgtccatcgagtccgtgatgccatccagccatctcatcctctgtcgtccccttctcctcctgcccccaatccctcccagcatcagagtcttttccaatgagtcaactcttcgcatgaggtggccaaagtactggagtttcagctttagcatcattccttccaaagaaatcccagggctgatctccttcagaatagactggttggatctccttgcagttcaagggactctcaagagtcttctccatcaccacagttcaaaagcatcaattcttcggtgctcagccttcttcacagtccaactctcacatccatacatgaccacaggaaaaaccatagccttgactagatggacctttgttggcaaagtaatgtctctgcttttgaatatgctatctaggttggtcataactttccttccaaggagtgagcgtctttgaatttcatggctgcagtcaccatctgcagtgattttggagcccaaaaaaataaagtctgacactgtttccactgtttccccatctatttcccatgaagtgatggggccggatgccatgatcttcgttttctgaatgttgagctttaagccaactttttcactcttcactttcactttcatcaagaggcttttgagttcctcttcactttctgccgtaagggtggtgtcatctgcatatctgaggttattgatatttctcccggcaatcttgattccagcttgtgtttcttccagtccagcgtttctcatgatgtactctgcatagaagttaaataaacagggtgacaatatacagccttgatgtactccttttcctatttggaaccagtctgttgttccatgtcctgttctaactgttgcttcctgacctgcatacaaatttctcaagaggcagatcaggtggtctggtattcgcatctctttcagaattttccacagtttattgtgatccacacagtcaaaggctttggcatagtcaataaagcagaaatagatgtttttctggaactctcttgctttttccatgatccagcggatattggcaatttgatctctggttcttctgccttttctaaaaccagcttgaacatcaggaagttcatggttcacatattgctgaagcctggcttggataattttaagcattactttactagcatgtgagatgagtgcaatttcaagtaatagataatagtatttgtgctcaatacatcaacttctaaaagaccttgagatttacaaataattctaaagtcaaatggggacattacagggatattgatttcagctgaatgtaagcgatactttattgaaacttgaggggtttaatagaataaattgccttgtgaatagtgattcccttgacaccagtgctacacgagtgagtatgacctgtgagagatactatagcgtaagaatcctaaattagaagaaattaggatgaccttgaggaggccctgtgcatacatgctaagtcacttcagtcatgtccgacttccagacccagggatcaaatccatgtcttctgtggctcctgcattgcaggtggattctttaccactgagccacctgggaagcccctgtggggccctcctaaatccaaaattccatgatttttatttatttattttggctgcactgggtcttggttgtagcatgtgggatctttttagctgcagcatgtgggatctagttccctgaccagggatcaaacccaggccccctgcatttggagcttggggtcttagccactgcaccatgaaggaactcccccaaagtccatgattttaaagtcagacaattaaagattgacctgaagcagagggatggtttctgagctaagaaatggagctccagggttctgattattccaactttcaaccactccccaagtatatttacattaactactaaatgtaagatatcccaagtgaatacacatgtgtgccatttggaataacattcattacagcatctaagaacttcctaaaagcttttaaggaagatttgctgattattttcattgtaaaagaattattgattttgtaacatcatgttttacaaatatggatagaaataacaaaacataagagaaaaaaaacagagagataaattaatctgcaattttagtcggagattttaaaactcatttttcagtacttaagggtgtaaataggcttcctccccaaaaatcatctttgttgttaatttcttaattttcattagaggacatcctccatattaattcaatattgttaaatgctttgatacttgttttctgtttctgaaatacttggaaattaagcaacataattctaaattgccatagttaaagaagaaatcccaaagaaatttggaaaatatttgaactcgaggataatgaaatcacaaaatatcaaaatttgtagcatgtagctaaagcactgattaaaagaaaacttatacctttaaatcttatatttgaaaagaataaagctctaaagtagtaatctaaaaatccacttaaagaatataggcttttaaagacaaaaacttaaagtgagtagtaaagtagaaataataaagttatgagcaaaatttaacagacaatagagttactttgaacactaagcattgatttatagatcactagttacttagccaaggtgcttgggtgactaaaaacaactttaaaactgccctttgaagtgcatttagaaagaaaaagaaacgttcaagccgccattagggaagcagagtgtgatttaattcctttggaaaaacacagagcaccccacagttccatgcaaaaatagctgaagcttctcgcgtgctgtaatgtgtcaataactttagaaacctcatttcatttactcctcacccaagccttatgaggcaatattattatctctattttgtaggtgagcaaactgggtctcggggaggttaagtaatttcttcctgagcataagttcaagtccaggtccttctgattctttcccttattccaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagctttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactatcagttattcctaggaggttgtatagtcttctgattggaagccacaaatttcatataaactagtccaagtaattgtgctagagctaagatactcaaacctgaaatcagaagagggccatgcattggtatacacgccgcaatacagagactcagtccaaccacagcgaggatataggctatcacctgaataaccaatatggcaatgacgaaggaggttaatccaatcgctgtactaaacacatagtagtgaagtaatattaatatccctgtagaagtcacaattaaaccaaggccagtagcattctttaatgaatattcacctgggacgaaaagaatggctccaacaatgacaatgacagtgatcactagtccagcaacaagtaaagcaattgttttctcatccataccaccggatctatatttaagtgttttaataccaaactgtccccagaacaggagtatagcaaaaattgggaaaataacaataagaatattttcatttggagaaaaccatgaaacaacacgatattttagctcgatgatcgtttcaccttctctggttaattctgttacttcacaagtgtagtttcctgtgtgtgagacagcatcactcttatccatcttcaaagaggcatctccttttagtaattgtgagacttcaatttttgcactactaaagtcagtggggacagtggacttgtttagagctccatcaaaggtgtaaatatctcttcctttaaatttccactttacgtatacttcagtagtgttttgtgcctccatattagtaacaaagcatggaatgacgacagtgtcattacaaaacgtgaattctacagattttgttttattaaatagtagctgagctgatccgcagcacgccgagcccagcaacagcgccgctaccaggggccacataggtccagggttctcctccacgtctccagcctgcttcagcaggctgaagttagtagctccgcttcccaagctgtgagactcagacccctgggcactgtcgctccactcagccttagagtagctccctccttttccacctgagctcttcttcctccatatcacagcagcaaccacagctccagagaccacagatccaaggagaaccaggccagcaatgatgcccacgatggggatggtgggctgggaagccggcttccatctcagggtgacgggctcgggtagcccctcatgctgcacatggcacgtgtatctctgctcctctccagaaggcaccaccacagctgcccacttctggaaggttccatcccctgcaggcctggtctccacgagctccgtgtcctgggtatggccctccccatcctgctgccaggtcagtgtgatctccgcagggtagaagcccagggcccagcacctcagggtggcctcatggtcagagatggggtggtgagtcacgtgtgtctttgggggctccaggtgaagcagcgtctccttccccttctccaggtatttgtggagccactccacgcatgtgtcttccaggtaggctctctggtgctccgcctcagaggcatcatttgacttttgctcggagatctgagccgccgtgtccaccgcggtccaggagcgcaggtcctcattcagggtgagataatccttgccgtcgtaggcgaactgttcatacccgcggaggaagcgcccgtcgggccccagctcgcagccatgcatccactgcagggtgtgagacccggcctcgctctgattgtagcagccgcgcagcgtccgcagattcactcggaaaatctgtgcggtgtccctggcgctccgtgtctcccggtcccaatactctgacccctcctgctccatccacggcgcccgcggcaccatcctcggactcgcggcgtcgttgtcgaagcgcacgaactgggtgtcgtccacgtagcccacagagatgaagcggggctccccgcggccgggccgggacacggaagtgtggaaatacttcaaggagtgagatccggaaccgccaccaccgcttcctccgccgccactaccgccaccaccagaaccgccaccacccatgtcgcgatcccacttaactatcttgggctgtgacaaagtcacatggttcacacggcaggcatactcatctttttcagtgggggtgaattcagtgtagtacaagagatagaaagaccagtccttgctgaaagacaagtctgaatgctccactttttcaattctctctccattcttcagtaagtcaacttcaatgtcggatggatgaaacccagacacatagcaattcaggaaatttgactttccattctctgctggatgacgtgagtaaacctgaatctttggcgtacgctggatggagccgccaccaccagaaccgccaccaccggaaccgccgcaacccaggaagagggttcggggcgccatgacagcctcgaggccagaaagagagagtagcgcgagcacagctaaggccacggagcgagacatggtggcggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatggggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgttaagtgccgcggtcgtcggcgcctccgccctcccccttgggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagcccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggctgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatccataacttcgtataggatactttatacgaagttat

SEQ ID NO: 177 - DNA, 36806 bp, synthetic construct
  misc_feature 1..36806: note = 17S3
  source 1..36806: mol_type = other DNA
ataacttcgtatagcatacattatacgaacggtataagctccctttcctgctttccaggaaaggttttttcatcctcagagcccaaagattgaatatggaaaaattatgaagtgttttgagcatctggcctctgcctaataaagacatttattttcattgcactggtgtatttaaattatttcactgtctcttactcagatgggcacatgggagggcaaaacactgaagacataaagaaatgaagggctagtcgagaccttgagaaaatatatcagtatcttggaccccatgacagcagtggttgtaaatagctgatgttatggaaaacaggctttgctccttagccttactctcccttaaagaattcaagttgcagcttgatttgggagttagatattgctaaattttatttaaataaattatgttatttaccctttcttgtaaatgtcttctttctctttaattatccagaatatcacttagattcattaagttcttctgcctaattacaccactgttttaagattttctttttgcattttactgtccccatttctctttctcccctgttctctttttatcctagttttctctgccatcttaaaagaactacaagaaagacagaaccttctgtgctggattcggaaaatgacatatgaattatgagtaatccttgttccttcttgcatcctaattctgaatctcagttcagttcacttcagtctctcagttatgtacgattctttgcaatcccatggactgcagcataccaggctcccctgtccatcaccaactcctggagcttgcttaaattcatgtccatcgagttggtgatgccattcaaccatttcatcctctgtcgtccccttcctctgctttcaatctttcccagcatcagggtcttttccagtgagtccgttcttcacatcaagtggccaaagtgttgaagtttcagcttcagcatcggtccttccaataaatattcaggacttatttcctttaggtttgactggtttcatctccttgcaccccaaggtactctcgagagtcttctccaacatcgcaatccgatggcatcaattctttggcagtcagctttctttatgatccaactctcacatccatacatggctactggaaaaaccatagctttgactagatggaactttgtcggccaagcaatgtctctgctttttaataagctgtctagctttttatagacagcttattatagcttgttatagcttttcttccaaggagcaagcatcttttaatttcatgtctgcagtcaccatatgcagtgactttggaggccaggaaaataaagtctgtcactatttccactgcttccatctctttgcaatcaagtgatgggaccggatgccatggtcttcattttttgactgttgagttttaagacagctttttaattctcttctttcactttcatgaagaggctgtttagttcctctttggtgtctgccataagggtgggtgtcatctgtatatatgaagttattgatatttctcctggcaaccttgattccagcttgtgcttcatccagccctgcatttctcatgatgtactctgcatagaagttaaataatcgaggtgacaatacgcagctttgacctatttctttccctgttctgaatccagttggggagatgctgaaagtaacacatctaacaagtgactgtaaatgagtgtattcaaggtttttatgagatcagataatgaagcccttggtatgaaatgggtagtaaagataagtagtacagacaattgtccaaaagacaagaagacaaaagtcagaaaagcaaaggatagcataggccaaatcactgatgaataatgtgtttgtgtattctgagaatttcaggtaaacagaaaaacaaatgaagcaaaactgcctgggatagaatagaatagatactatattttggtgtacactgtggacacattcttaaagttaaaaattcaccaagaagattccatctagacattactcacaagatatttgcactggtaatcagccacagaatgaggtgtccataggcattaaggaaagtggtagaaaagaagcacccagcgtagctcgggttagtgaaccgaggcacttcatgctgcatatttgtattgcacgtttcagtgtacatcgtgtttcacttcctatatctcgttggacacttcagtttgccatatgatatgtccagggggttcaggcacggaggaagggcctcggaagacctcggggggagaggggcaggcactgctgtgtattgatggggggattgtttgcactggttgatgatctctgaacaaccaagaagtacacaaggatctacctaactggacgtgctaagtaatttcactttggggattattctccagggagacgatccattgatagagaagtgaaaagcatcgagatgtgtctagtagttgtaggaagtctggggtgctttcctgatggggtgccctcagctggaaatagcccctccttcctttgacctgtcctgtggctatttgcagacattttattcctcttaccagactgtaagctctttgaggctggatttctgccttttgtctattcattcattcactcattcttctattcatgcattcaccaattccacaagtagttgttgcctgtaacatgtgccagagattgtaccaggcagatgggcatatctagataagcaaaagacatgatcctttctcttctggagctaacaatctactgggggcagagataatagcaaacaagtaaatatataatggttaaatagaaatttcgaatttggaacattctcatgaggaaaacagctaagatatggagggagagaagaagccagaaggtgacgggacgaggcagctggcacagccctaggcccaggaattcaacaggcatctactgagtggacccaacgcatgagaggacagtgccaagcaagcaactcaaatgtcccaccggttgggcatggccaggtagcctatgctgtgtctggacgtcctcctgctggtatagttattttaaaatcagaaggacagggaagggagcagtggttcacgcctgtaatcccagcaatttgggaggccaaggtgggtagatcacctgagattaggagttggagaccagcctggccaatatggtgaaaccccgtctctaccaaaaaaacaaaaattagctgagcctggtcatgcatgcctggaatcccaacaactcgggaggctgaggcaggagaatcgcttgaacccaggaggcggagattgcagtgagccaagattgtgccactgcactccagcttggttcccaatagaccccgcaggccctacaggttgtcttcccaacttgccccttgctccataccacccccctccaccccataatattatagaaggacacctagtcagacaaaatgatgcaacttaattttattaggacaaggctggtgggcactggagtggcaacttccagggccaggagaggcactggggaggggtcacagggatgccacccgggcagtcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcatagggtcattaattgtaaaggaaaggtgccgacctccggtcacctattcaggcatagaagctttttaaaccgagcgcttttatagaagccccagtccccttctcagatcccgagtgtcgcgtgttacctcggggtacctgaagggcatccttagcctgtcaccagtgtgtgggtaccagtttcaatgtcactttaaagtgggtttcgcagtaaagtcgccgtgctggggttgcacacatgacgggcccgtgtgggcgtggcttttggccccgtgggtccttgttaccaaggaggagttcccacggccgtcatgctccgctacgaagcaacagtgctgttactaacactcgccagtggatcgagcgtggagccaaacacagtacaaagtgttacccctctagacctggaaagaccaggcggagtttcaagttgcacgttttgtgtcagttggggaaacctgcttattaaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggctgtctgttacaacacaaaaacaacaggaaaaaaaaaagcccaaagttcagcaagaaattcacaggccaatatatacccagtgctaaataattcattatcactttgtagtagccaaataactgacgtgcctaaaaacctcacaggcttgacaattaacctcaaatccaacgtctcaggcgtttaagaaagcaaaacatggaaacctgacccaggtaaattcgcggacctacttatcctccccctcaatggatgtctgtcctctgtcaacacggcagcgtttaccccaggcccaaaccctgtgtccccaaactactaaacatcttcctacacacatagcggcaggtggccccaccctaggctatgagcccacaaaaaggggtgaggcctcgtcacggtcgtggatcgcaagtcccctgccccagaagcgttcaggccaactcagcggcaccagcagttagtgtcccttcacagggacggaaaaccgaagttctcgccgcgcgccagccagccagtcgagccggaaagcaatgacctagcattcgatccccgaaacactgcacaaccccgttccacaaacggccgggccccgccatcaatggaagcctccgcgcctctcgtttccgtttcacccagtgctcctcgcccgcccccaatttctctctcccacctcagagcccgcttcagaggccggcttctcccacagagagattgggaacggccgccattttgctctaggtggccgttcgtcttaaggctattccgcacgagggccccgggtgactaagcagctcggctgcccttccgccgcggcgggcaagcagacctcccgcacccacccccgcagccgcaagacccccggacgtccgcctcaccaggtggcagtggcaacagcggtcacagaagaaacgcaggcaaactcccggcctccacgaaactgcctgcgccacacccggtgcttccttatatagccatcggtagcaccgccccagtagattcctccgcagaaacgccgagaagggactacttttcgcggcccttcctgccctctgaagagagaagcagtccccccagaatcttctaatttcactcctagaatgctttcctgtgaagactcgaacactggggctgattttgggggggggggacgaggccttagtcctgagcggccgagcggagggatcagcgtgttcgctgaacactgcgtccgcggacagggccggtactcggctggttggggggggtgtgggggaggtgccgcggaaggtgcgaaaacccgacacggagtcctctgagcgtccggagggggctgtccccgctgccggtccccggcgccccctcccctcaaccaggaaggctcgcctttcctgagacccgccctcggctaacaggggtcccgccgagcgcctcacgatgaatcggggtcccgctcccctggcccgagttccgccgtgcccctccccccaacccctcttccccgccagcgaaaccgtggggtctttattctgggtctcccataggtaacgatagtgtttctgtttccataaacttcccctcacccccagtgggtcgcgaggacttcccggggggtctagtcaccccaactgtggcggccgaacccatccccctgcgggcgggcaccgggacaagaggaatgactcgacaaatctcggggccgggcctcaagcccgcctcaggagggtcgtcaggacctgcaggaattttctcacaacgcaggagtgaaaaataagtgtccaaaggagaaatgcctgtgacaagttcacattgaattttgaaaagtaaaagcaaaaattccacacagctgtgaaacactccttgcgctggacctgaaagctgacagaactttgcggattgctcttcggccttcctgttttgttcccgattatgagcaagaaggcatcagaatttcacttctgctgccatttgaactcagaaatcagaaatcaaatctatttaaacccacgttttctttttttcttttttttaattttattttttaatgaagttttttattgtagttgatttataatgtcaatttctgctttacagcaaaatgatagtcatgcatatatatacatttcctttcttatcgctgagcctgagatttttaaaaggacactaattgtaagttctgtatagtcctggtggaaaaaagaccccaagtatgaaatttaaatctatagacaaattccatttggataaaagaaaaagatcaccagtcagatctttttcattttgatattttattttgtgatctctgtgtcatttctccagcatattttttccttttttcaaaaagcatacttaaatttttttccaaaggcatattttaaaaatgttttaaaatatatgaacgtgatgaaaacttaaaacaggttttctatagtttataatgaaaaacctccctcatgcactcaattccctagccactgttctttctagactcttctagaaatattctctatttctataaatgtggggagggtgtttttaatttttacccttgaagctttcaataaatatatagaaaaagagagaaccgactaaaaaataccctgctattaggaaaagactacattcctgttggaattataaacattatgttatttaaatactgtacttaaaatgagaataaaaacaaaactatgttttctttggcaacctgtgtctgtaggtatttatgggaaaggtctaagcagtattcaaaacagactttaactcctatcgttttaaacattttcaaagagaatgaattcattaccaagaaatgtaaatgaataataaaaataaaatgtcatttttcagtttagcaggagacctcagtgacttccagtagagatttctgtgagggatatttctaaatttctgaaaagagggtttaaaggaacagaacatcaaagctctgtataaggtttccttcttgaattccagaaagaagttttcagaggaacaaaaagctgaggttctttctcaggtgactaggcctggcttcaaaccacaccctgttttcttttggctgttctttcactgcaggtcttatgattcatgttgtttaaaggctgagtcacgagctttgtgacatagcttttttttcaagagtccaaaaactacagagaaaaacagacctgatttcagaggcaagggaaggtgaaaaggagaaagagggggagagggggaagaagaaaggctccaagggtgaggactgggtcccagggctatctccaaagagaaaacaatattcttaggcgctaacaacactgatgttgtctctagcaggaaaattctctactagagaattttggtctctaagtccaacagtgggttttgttgaagcaaatagaaataaacatttgtccaagggcactgaagtgaaagggaggagggggaagtaaactctcagggaggtagatgctgtttctctagagcagtggttctcaaccaggagcgacttggtcccttggtggacacttggcagtatctggagacatttttgcttgtcacagctgtggtgttggggttgaggtgtgccgctaaaatctagtggtagaggccagggatgttactaaacatcctgcagtggccagtcccccacaaaaacagaattacccagcccccaaagtcagcaatgcaatgggttgacaaattctgctctacggaggatttttgttgtttttgttagagctgcttttctgtttgctgagaagggctcccaaagtctaaatgtcccacttggattcggggatcgtgtaccaagtcacgttcctacaacctaaaatcccttgacctagaatgcaatgtgctagaatatgccagaagcaggatgagtcattggatccattttcagttccttccacccactgatccatcctttgcaggtgccccagaagggatggcttcagagctggcaccaatggaagagtgacagaggcccagcaacacggcaggattggcgggcaggcaagagcacgtgatgggctgagctcacaaagggcctgggtgttgggctgttggggattggactggagcctacctgtctgcctttcctcctttccccaaaggattcagctctcctgaaggtcaccaccttgtatgggacttaactcagcgtcatgagagtgtctacgtagtgaccagcaaacattttctttccaagagaaagggtgaaatctgagagctggacgggaaaggtttgacttgcgtcatcatcagttatataaccataaaagggaatctgcagcttaggagagaaaaaataaaaagaagccctagggactctactctgtccgttttcctgcttacatttatgtatttgcattctgtggcagaacacaaactgctccagcgagttcactcagactcacgtccatcgagtccgtgatgccatccagccatctcatcctctgtcgtccccttctcctcctgcccccaatccctcccagcatcagagtcttttccaatgagtcaactcttcgcatgaggtggccaaagtactggagtttcagctttagcatcattccttccaaagaaatcccagggctgatctccttcagaatagactggttggatctccttgcagttcaagggactctcaagagtcttctccatcaccacagttcaaaagcatcaattcttcggtgctcagccttcttcacagtccaactctcacatccatacatgaccacaggaaaaaccatagccttgactagatggacctttgttggcaaagtaatgtctctgcttttgaatatgctatctaggttggtcataactttccttccaaggagtgagcgtctttgaatttcatggctgcagtcaccatctgcagtgattttggagcccaaaaaaataaagtctgacactgtttccactgtttccccatctatttcccatgaagtgatggggccggatgccatgatcttcgttttctgaatgttgagctttaagccaactttttcactcttcactttcactttcatcaagaggcttttgagttcctcttcactttctgccgtaagggtggtgtcatctgcatatctgaggttattgatatttctcccggcaatcttgattccagcttgtgtttcttccagtccagcgtttctcatgatgtactctgcatagaagttaaataaacagggtgacaatatacagccttgatgtactccttttcctatttggaaccagtctgttgttccatgtcctgttctaactgttgcttcctgacctgcatacaaatttctcaagaggcagatcaggtggtctggtattcgcatctctttcagaattttccacagtttattgtgatccacacagtcaaaggctttggcatagtcaataaagcagaaatagatgtttttctggaactctcttgctttttccatgatccagcggatattggcaatttgatctctggttcttctgccttttctaaaaccagcttgaacatcaggaagttcatggttcacatattgctgaagcctggcttggataattttaagcattactttactagcatgtgagatgagtgcaatttcaagtaatagataatagtatttgtgctcaatacatcaacttctaaaagaccttgagatttacaaataattctaaagtcaaatggggacattacagggatattgatttcagctgaatgtaagcgatactttattgaaacttgaggggtttaatagaataaattgccttgtgaatagtgattcccttgacaccagtgctacacgagtgagtatgacctgtgagagatactatagcgtaagaatcctaaattagaagaaattaggatgaccttgaggaggccctgtgcatacatgctaagtcacttcagtcatgtccgacttccagacccagggatcaaatccatgtcttctgtggctcctgcattgcaggtggattctttaccactgagccacctgggaagcccctgtggggccctcctaaatccaaaattccatgatttttatttatttattttggctgcactgggtcttggttgtagcatgtgggatctttttagctgcagcatgtgggatctagttccctgaccagggatcaaacccaggccccctgcatttggagcttggggtcttagccactgcaccatgaaggaactcccccaaagtccatgattttaaagtcagacaattaaagattgacctgaagcagagggatggtttctgagctaagaaatggagctccagggttctgattattccaactttcaaccactccccaagtatatttacattaactactaaatgtaagatatcccaagtgaatacacatgtgtgccatttggaataacattcattacagcatctaagaacttcctaaaagcttttaaggaagatttgctgattattttcattgtaaaagaattattgattttgtaacatcatgttttacaaatatggatagaaataacaaaacataagagaaaaaaaacagagagataaattaatctgcaattttagtcggagattttaaaactcatttttcagtacttaagggtgtaaataggcttcctccccaaaaatcatctttgttgttaatttcttaattttcattagaggacatcctccatattaattcaatattgttaaatgctttgatacttgttttctgtttctgaaatacttggaaattaagcaacataattctaaattgccatagttaaagaagaaatcccaaagaaatttggaaaatatttgaactcgaggataatgaaatcacaaaatatcaaaatttgtagcatgtagctaaagcactgattaaaagaaaacttatacctttaaatcttatatttgaaaagaataaagctctaaagtagtaatctaaaaatccacttaaagaatataggcttttaaagacaaaaacttaaagtgagtagtaaagtagaaataataaagttatgagcaaaatttaacagacaatagagttactttgaacactaagcattgatttatagatcactagttacttagccaaggtgcttgggtgactaaaaacaactttaaaactgccctttgaagtgcatttagaaagaaaaagaaacgttcaagccgccattagggaagcagagtgtgatttaattcctttggaaaaacacagagcaccccacagttccatgcaaaaatagctgaagcttctcgcgtgctgtaatgtgtcaataactttagaaacctcatttcatttactcctcacccaagccttatgaggcaatattattatctctattttgtaggtgagcaaactgggtctcggggaggttaagtaatttcttcctgagcataagttcaagtccaggtccttctgattctttcccttattccaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagctttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactatcagttattcctaggaggttgtatagtcttctgattggaagccacaaatttcatataaactagtccaagtaattgtgctagagctaagatactcaaacctgaaatcagaagagggccatgcattggtatacacgccgcaatacagagactcagtccaaccacagcgaggatataggctatcacctgaataaccaatatggcaatgacgaaggaggttaatccaatcgctgtactaaacacatagtagtgaagtaatattaatatccctgtagaagtcacaattaaaccaaggccagtagcattctttaatgaatattcacctgggacgaaaagaatggctccaacaatgacaatgacagtgatcactagtccagcaacaagtaaagcaattgttttctcatccataccaccggatctatatttaagtgttttaataccaaactgtccccagaacaggagtatagcaaaaattgggaaaataacaataagaatattttcatttggagaaaaccatgaaacaacacgatattttagctcgatgatcgtttcaccttctctggttaattctgttacttcacaagtgtagtttcctgtgtgtgagacagcatcactcttatccatcttcaaagaggcatctccttttagtaattgtgagacttcaatttttgcactactaaagtcagtggggacagtggacttgtttagagctccatcaaaggtgtaaatatctcttcctttaaatttccactttacgtatacttcagtagtgttttgtgcctccatattagtaacaaagcatggaatgacgacagtgtcattacaaaacgtgaattctacagattttgttttattaaatagtagctgagctgatccgcagcacgccgagcccagcaacagcgccgctaccaggggccacataggtccagggttctcctccacgtctccagcctgcttcagcaggctgaagttagtagctccgcttcccaagctgtgagactcagacccctgggcactgtcgctccactcagccttagagtagctccctccttttccacctgagctcttcttcctccatatcacagcagcaaccacagctccagagaccacagatccaaggagaaccaggccagcaatgatgcccacgatggggatggtgggctgggaagccggcttccatctcagggtgacgggctcgggtagcccctcatgctgcacatggcacgtgtatctctgctcctctccagaaggcaccaccacagctgcccacttctggaaggttccatcccctgcaggcctggtctccacgagctccgtgtcctgggtatggccctccccatcctgctgccaggtcagtgtgatctccgcagggtagaagcccagggcccagcacctcagggtggcctcatggtcagagatggggtggtgagtcacgtgtgtctttgggggctccaggtgaagcagcgtctccttccccttctccaggtatttgtggagccactccacgcatgtgtcttccaggtaggctctctggtgctccgcctcagaggcatcatttgacttttgctcggagatctgagccgccgtgtccaccgcggtccaggagcgcaggtcctcattcagggtgagataatccttgccgtcgtaggcgaactgttcatacccgcggaggaagcgcccgtcgggccccagctcgcagccatgcatccactgcagggtgtgagacccggcctcgctctgattgtagcagccgcgcagcgtccgcagattcactcggaaaatctgtgcggtgtccctggcgctccgtgtctcccggtcccaatactctgacccctcctgctccatccacggcgcccgcggcaccatcctcggactcgcggcgtcgttgtcgaagcgcacgaactgggtgtcgtccacgtagcccacagagatgaagcggggctccccgcggccgggccgggacacggaagtgtggaaatacttcaaggagtgagatccggaaccgccaccaccgcttcctccgccgccactaccgccaccaccagaaccgccaccacccatgtcgcgatcccacttaactatcttgggctgtgacaaagtcacatggttcacacggcaggcatactcatctttttcagtgggggtgaattcagtgtagtacaagagatagaaagaccagtccttgctgaaagacaagtctgaatgctccactttttcaattctctctccattcttcagtaagtcaacttcaatgtcggatggatgaaacccagacacatagcaattcaggaaatttgactttccattctctgctggatgacgtgagtaaacctgaatctttggcgtacgctggatggagccgccaccaccagaaccgccaccaccggaaccgccgcaacccaggaagagggttcggggcgccatgacagcctcgaggccagaaagagagagtagcgcgagcacagctaaggccacggagcgagacatggtggcggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatggggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgttaagtgccgcggtcgtcggcgcctccgccctcccccttgggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagcccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggctgataataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcttattaaagcagctgggacagggacagaaaaagggctttgactgcctttctcttgagcccttttcctgatctccacaactcactgataccactggtctcattggaaggggtgggctgttaacagtgtgacaaatgtaggaataaactggatgcaaaagggggctttgtgcagctttatattcactgttgtcttaaaccctttttatggactcaaatcaaatgacagtccctcaggatgttagcttctgaattcagaaagtgattgcagagttgcccactcctttatcctgtgtctgatggttttgctgtctctgtagtgattagcttactgtcaccatttcctcattcaataggcactcaggtggatgaaaggttctggttcactccccaaatacctgcaacagtcaggagtgtgtcaggccaaaaccagaaaacaggaattgccatggggtctccatgatgggtggcagggactcaagtacatgagccatattcggctgcttccaggtacattagcagaaaactagatcagaagtggagctgtggggaccagaataaacactttgatatgggatgttggtgtctcaagtagcaacttaaccccctgctcactaaaacactctaatcctcattacctaggagcaactgagcctgagggctatctaatatagctggtgacacagagatcatataccctggctaaaagcatggctgaatccatgaaagaaaatatatgctcaaaataggaatagaatacacagatttatgcacagatgcttacaaattttagccaatcctgatgacatggttaacttggagatctagatcagttcttgccagcatgcccagagaatagtacatgggaaaatttatagagatgatgagttagagacaaagtgagtgataatgacattgcctgggattgctgctaggtacactgaaaaatcagggaggaagatccaataaatgacccattcaaaatctagaaaacctgtcaacaggaactttggaaacttatttctaatttatctgttcatcaaggcagcaataagtctttctgtaaaatcattaaatatgcccaaatgtcaagttctatgtgagtcatgaaggtaacttgataatgctctacacttcatattttgttcaattgtttaatacaaaaagcacttttattttatttatttaattttttaaacgtttatttaataaatataaatttccaaattacagcttatagattacaatggcttcaccctcataacttccctcccacctgcaaccctcccatctcctgctccctctcccattccattcacatcaagattcatttttaattatctttatatacagaagatcaatttagtatatattaagtaaagattttaacagtttgcacccacacagaacataaagtataaatactgtttgagtactagttatagcattaattcacattgaacaacacattaaggacagagatcctacatgaggagtaagtgcacagcgactcctgtcgttgacttaacaaattgacattcttgtttagggggtcagttatctccccaggctcctgtcatgagttaccaaggctatggaggccttttgagttcactgacttcgatcttatttagacaaggtcatagtgaaagtggaagtccactcctccctttagagaacggtacctccttcctcaatggcccattctttcaactgggatctcgctcacagagatctttcatttagctcatttaactcctttttttttttttttttctagagcatcttacctttccattgcctgaaatactttcatgggctcttcagccagatgtgaatgccttaagggctgattctgaggccagagtgctgtttaggacatgtgccattctatgagtctgatgtgtatcccatttcccatgttggaatgttctctccatttttaattctgtcagttagtattagcagacactagtcttgtttatgtgatccctctgactcttatgcctatcattacgatcaattgtgaacagaaattgatcactgggactagtgagatggcattggaacatgccacctcaatgggattgaattcgaatcccctggtctgtttctaactctaccatttgaggtaagtcagtttgagcatgtcccgaattgcacatctcttccctctcttattcccactcttatatttaacagggattacttttcagttaaatttaaacacctaagaataattgtgtgttaattacagagttcaaccaatagtattaagtagaacaaccaaaaaatactaaaagggataaagtattacattgtacatcaacagtcaggacaagggctgttcaagtcactgtttctcatagtgttcatttcactttgacaggtttccgggtttcttcccccaaaggaagtatttcttttgcatatgcttcggagccactcttagctctggccacatagtaggttctcaaatatttgttgatagattggctcaaaaagttgcagtagtgctctacacgtggaagagacgatctagtaattagctcatttaaaataaaggttcctctttcttcaggaatatttttgaatatctgcctgattgccaaccaaaaaggcctcatcttgtcttgccctggatttatgcctaaaatgcagtcacaatggataggacgacaaaagatgaagccgtttattcaaatgggataggccatttttgagaaacagtgatttcacagcaaacgttggagtagtaaattgggtggataagcttcctggcgctgtagatcttagtctctacttgagatcgtgtataagcactgaactcaaaaaattctttttaggtttttcatgcttgcaaccaagagtatacactggaaaaaaaatgttaataggagggtagacacacactcagggtcttaaacgtaataaaattaggattagaagtaaagaaaactgtagtacttaagtctattctaaactcaaaaactggacgtctggagtaccacgtggtgtgtagaacgaacttagataaaagaactgaatggaaaaagccaagaggtcagcgcaggagcctgttcgccaggctgttggtcagcaaactgagccactcgcggattctcggccctgaagaccgccccgaggcccctgccgccgcggttccccggccttttacgcctccctctccagccggaaggggcgcggacggcaagggcggtggagaagccccggcagaggaagcggctccaggggttagtccttaacctgcgagaccgcaagactgaggaccggtggggtactgccgggtaagggctcccatctcggtccaactttgcagttaagctacgaccggttcagggaagattctggacgcctccccgccgccccaccccccagctgtgcggagagtaattcatacaaaaggaggactctcctcagccagggaaatcccagggaccgtcgataaactcccactaaacctagaaccgagtgagcgctcgaccccgcctcccacccaccagcagtcgtcatcctcctggttgagaggagcatgcgccgggcgccgtgtgctcgtcagtgggctgaacgcacatcgcccacggtccccgaagatggggggaggggacggcggtggaaccggtgccgggtggaggtggcgcggggtaaactgggaaagtggtgtcgtgtgctggctccgcccttttccccgagggtgggggaggaccatatataagcgccgtggtccccgcgaacgttctttttcgcaacgggtttgccgccaggacacaggtgagtacgggtgtggcctccgtccgcatggcctccgccggtggccacggccttagcgtgcctcccggccccccgcgcgtagagggctctgcgccctggtcctgattccgagctgcgggcggggggaggtggagaactcgaggccctccgctctcgcggttccctaccgcgtgcccggtggcggcctgctggggcgccgtggccgccgcgtgcgatccgcgccttcgcgcccgccccgtctgtcttcgcgctcgagttcggccggcagccgcgtgttactgccagggcggcccagccgaggccgcccaaggtggcctccgtgcccggcggtcccggggcagacggccgcggcggggcggggcgggcggtcggagacccagcgccccgcccgggcgggctgcgagcgcggaaagatggccgctcccggtctcaagatggaggacgcggacggcgggcggcgcacaaagggccgggcggtgctgcccgcgccgcttcccgggactcgcggcccgggtgggggaggggctgggcgccggggcggccccgttcgctgggtgtaggccgggcagggcccgcagggcgccggtgctaatgctccctggagtttgcccttggctgttggggttgtgcctgagtctccggtcgtcgggacagtagtttaaagaaggtttttgtcgtcttaggtgtcgtgaaagccatcgctaaaagctaagcaaaagccaccatggctgagcaactccttcccctggctttgtatttgagcaacatgcggaaggctgtgaagataagagagagaactccagaagatattttcaaacctaccaatggaatcattcaccattttaaatccatgcaccgatacactctggaaatgttcagaacctgccagttttgtccgcaatttcgggagatcatccacaaagctctcatcgacaggaacatccaggcctccctggaaagccagaagaagctcaactggtgtcgagaagtgaggaagcttgtggcactgaaaacgaatggggacgggaactgcctcatgcatgctgcttcccagtacatgtggggtgttcaggacacagacttggtgctgaggaaggcgctcttcagcaccctcaaggagacggacacacgcaacttcaaatttcgctggcagctggagtcccttaaatctcaggaattcgtggaaacggggctttgctatgacacccggaattggactgaggaatgggacaaccttatcaaaatggcatccacggacacaccagtggcccgaagtggacttcagtataattcactggaagaaatacacatattcgtcctttgcaacatcctcaggaggccaatcatcgtcatttcagacaagatgctgagaagtttggaatcgggttctaatttcgctcctctgaaggtgggcggaatttacttgcctctgcattggcccgcccaggaatgctacagataccctatcgttctcggctacgacagccaacactttgtccccctggtgaccctgaaggacagtgggccagaaatccgagctattccacttgttaacagagagcgaggaagattcgaagacttaaaagttcacttcttgacagatcccgaaaatgagatgaaggaaaagctcctgaaagagtacttgacggtgatagaaatccccgttcaaggctgggaccatggcaccacccatctaattaatgctgcaaagttggatgaagctaacttacccaaagaaataaacctggtagacgattacttcgaacttgtccagcatgagtacaagaagtggcaggaaaacaatgagcaggggcggagagccacgcaccctcagaaccctctggagccttccgtgccccagctttctctcatggacatcaagtgcgagacgcccaactgccctttcttcatgtcggtgaacacccagcccttgtgccacgagtgctcagagagacggcagaagaaccaaagcaaacccccaaagcccacctccaagccggaccccgaggcgctgcccggcctggcgcttggagcctcccgcggggaggcctggaaccccgaggagccctctgggggcccccgctcagcccctccgacggctcccagcctcttcctgttcagcgagactacggccatgaagtgcaggagccccggctgccccttcacgctcaacgtgcagcacaacggcttctgcgagcgatgccacaacgcccggcagctcaaccccggccaccccccggaccccacgcgccatctcgaccccagcaagtgccaagcctgcctccagaacgtcaccaggacgtttaacgggatctgcagcacttgctttaaaaggactacggctgagcccgcctccagcctcggctccagcatccccctatcctgccaccagcgctccaagtccgacccctcgcaactggcccagagcgtctccccacacccctgccgcagagccgggcctgaggctccctctggctgctccgcctcggccgcacggactccgggggacaggacggggacgagcaagtgcagaaaagccggctgcatgtactttgggactccggaaaacaaaggcttttgcacgctgtgtttcattgagtacagagaaaataaacatttcgtcactgcctcggggaaagccagtcccacggcctccaggttccagaatgccgtcccctgcctgggcagggaatgtggcgccctcggaagcacggtgtttgaaggatactgtcagaagtgtttcattgaggctcagaatcagagatttcatgaagcaaaaaggactgaagagcagctgaggctgagccagcgcagagacttgtcgcgagccacccagagcgcttccaggtccaagtgcgcccgggccacctgcaggaacgtgctggcctgctgcagccaggagctgtgcatagagtgccagccccttggccaacgagtgagccctggcgcccggcggccagagcccgtcccagaggatcccccgacgcagcgctgccgggcccccgcctgcgaccatttcggcaatgccaagtgtaacggctactgcaatgagtgctttcaattcaagcagatgtatggcggcagcggcgccaccaatttctcactactgaaacaggccggtgacgtcgaggagaaccccgggcctatggagcactcacagcccaacagcatgccccaggatttgtcagaggccctgaaggaggccaccaaggaggtgcacgtccaggctgagaatgccgagttcatgaagaactttcagaagggcgaggtcacccgagaaggctttaagctggtgatggcgtccttgtaccacatctacgatgccctggaggaggagattgagcacaacaaggagaacccggtctacacgcccctctacttcccggaagagctgcaccgccgggccgccctggagcaggacatggccttctggtatgggccccgctggcaggaggccatcccctacacgcaggccaccaagcgctacgtgcggcgactgcagcaggtggggcgcttcgagcccgagctgctggtggcccacgcctacacccgctacatgggtgacctgtctgggggccaggtcctcaagaagattgctcagaaggccctggacctgcccagctccggggagggcctggccttcttcactttccccaatgtcgccaacgccaccaagttcaagcagctgtaccgctcccgaatgaacactctggagatgacccccgaggtcaagcagagggtcctcgaagaagccaagaccgccttcctgctcaacattcagctgtttgaggaggtgcaggagctgctgacccaggacactaaggaccagagaccctcgcaggcatccgacatccgcaagagggccggcagccgggtgcaagactccactcccgtgacaacccccagggggaagccgcagctcagcgtcctctcccaggtgccgctcatccgatgggtcctgacactcagctttctggtggcaacggtcgccatggggctttatgccatgtgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatccataacttcgtataggatactttatacgaagttat

SEQ ID NO: 178 - DNA, 4361 bp, Sus scrofa
  source 1..4361: mol_type = genomic DNA
tgtctgttacaacacaaaaacaacaggaaaaaaaaaagcccaaagttcagcaagaaattcacaggccaatatatacccagtgctaaataattcattatcactttgtagtagccaaataactgacgtgcctaaaaacctcacaggcttgacaattaacctcaaatccaacgtctcaggcgtttaagaaagcaaaacatggaaacctgacccaggtaaattcgcggacctacttatcctccccctcaatggatgtctgtcctctgtcaacacggcagcgtttaccccaggcccaaaccctgtgtccccaaactactaaacatcttcctacacacatagcggcaggtggccccaccctaggctatgagcccacaaaaaggggtgaggcctcgtcacggtcgtggatcgcaagtcccctgccccagaagcgttcaggccaactcagcggcaccagcagttagtgtcccttcacagggacggaaaaccgaagttctcgccgcgcgccagccagccagtcgagccggaaagcaatgacctagcattcgatccccgaaacactgcacaaccccgttccacaaacggccgggccccgccatcaatggaagcctccgcgcctctcgtttccgtttcacccagtgctcctcgcccgcccccaatttctctctcccacctcagagcccgcttcagaggccggcttctcccacagagagattgggaacggccgccattttgctctaggtggccgttcgtcttaaggctattccgcacgagggccccgggtgactaagcagctcggctgcccttccgccgcggcgggcaagcagacctcccgcacccacccccgcagccgcaagacccccggacgtccgcctcaccaggtggcagtggcaacagcggtcacagaagaaacgcaggcaaactcccggcctccacgaaactgcctgcgccacacccggtgcttccttatatagccatcggtagcaccgccccagtagattcctccgcagaaacgccgagaagggactacttttcgcggcccttcctgccctctgaagagagaagcagtccccccagaatcttctaatttcactcctagaatgctttcctgtgaagactcgaacactggggctgattttgggggggggggacgaggccttagtcctgagcggccgagcggagggatcagcgtgttcgctgaacactgcgtccgcggacagggccggtactcggctggttggggggggtgtgggggaggtgccgcggaaggtgcgaaaacccgacacggagtcctctgagcgtccggagggggctgtccccgctgccggtccccggcgccccctcccctcaaccaggaaggctcgcctttcctgagacccgccctcggctaacaggggtcccgccgagcgcctcacgatgaatcggggtcccgctcccctggcccgagttccgccgtgcccctccccccaacccctcttccccgccagcgaaaccgtggggtctttattctgggtctcccataggtaacgatagtgtttctgtttccataaacttcccctcacccccagtgggtcgcgaggacttcccggggggtctagtcaccccaactgtggcggccgaacccatccccctgcgggcgggcaccgggacaagaggaatgactcgacaaatctcggggccgggcctcaagcccgcctcaggagggtcgtcaggacctgcaggaattttctcacaacgcaggagtgaaaaataagtgtccaaaggagaaatgcctgtgacaagttcacattgaattttgaaaagtaaaagcaaaaattccacacagctgtgaaacactccttgcgctggacctgaaagctgacagaactttgcggattgctcttcggccttcctgttttgttcccgattatgagcaagaaggcatcagaatttcacttctgctgccatttgaactcagaaatcagaaatcaaatctatttaaacccacgttttctttttttcttttttttaattttattttttaatgaagttttttattgtagttgatttataatgtcaatttctgctttacagcaaaatgatagtcatgcatatatatacatttcctttcttatcgctgagcctgagatttttaaaaggacactaattgtaagttctgtatagtcctggtggaaaaaagaccccaagtatgaaatttaaatctatagacaaattccatttggataaaagaaaaagatcaccagtcagatctttttcattttgatattttattttgtgatctctgtgtcatttctccagcatattttttccttttttcaaaaagcatacttaaatttttttccaaaggcatattttaaaaatgttttaaaatatatgaacgtgatgaaaacttaaaacaggttttctatagtttataatgaaaaacctccctcatgcactcaattccctagccactgttctttctagactcttctagaaatattctctatttctataaatgtggggagggtgtttttaatttttacccttgaagctttcaataaatatatagaaaaagagagaaccgactaaaaaataccctgctattaggaaaagactacattcctgttggaattataaacattatgttatttaaatactgtacttaaaatgagaataaaaacaaaactatgttttctttggcaacctgtgtctgtaggtatttatgggaaaggtctaagcagtattcaaaacagactttaactcctatcgttttaaacattttcaaagagaatgaattcattaccaagaaatgtaaatgaataataaaaataaaatgtcatttttcagtttagcaggagacctcagtgacttccagtagagatttctgtgagggatatttctaaatttctgaaaagagggtttaaaggaacagaacatcaaagctctgtataaggtttccttcttgaattccagaaagaagttttcagaggaacaaaaagctgaggttctttctcaggtgactaggcctggcttcaaaccacaccctgttttcttttggctgttctttcactgcaggtcttatgattcatgttgtttaaaggctgagtcacgagctttgtgacatagcttttttttcaagagtccaaaaactacagagaaaaacagacctgatttcagaggcaagggaaggtgaaaaggagaaagagggggagagggggaagaagaaaggctccaagggtgaggactgggtcccagggctatctccaaagagaaaacaatattcttaggcgctaacaacactgatgttgtctctagcaggaaaattctctactagagaattttggtctctaagtccaacagtgggttttgttgaagcaaatagaaataaacatttgtccaagggcactgaagtgaaagggaggagggggaagtaaactctcagggaggtagatgctgtttctctagagcagtggttctcaaccaggagcgacttggtcccttggtggacacttggcagtatctggagacatttttgcttgtcacagctgtggtgttggggttgaggtgtgccgctaaaatctagtggtagaggccagggatgttactaaacatcctgcagtggccagtcccccacaaaaacagaattacccagcccccaaagtcagcaatgcaatgggttgacaaattctgctctacggaggatttttgttgtttttgttagagctgcttttctgtttgctgagaagggctcccaaagtctaaatgtcccacttggattcggggatcgtgtaccaagtcacgttcctacaacctaaaatcccttgacctagaatgcaatgtgctagaatatgccagaagcaggatgagtcattggatccattttcagttccttccacccactgatccatcctttgcaggtgccccagaagggatggcttcagagctggcaccaatggaagagtgacagaggcccagcaacacggcaggattggcgggcaggcaagagcacgtgatgggctgagctcacaaagggcctgggtgttgggctgttggggattggactggagcctacctgtctgcctttcctcctttccccaaaggattcagctctcctgaaggtcaccaccttgtatgggacttaactcagcgtcatgagagtgtctacgtagtgaccagcaaacattttctttccaagagaaagggtgaaatctgagagctggacgggaaaggtttgacttgcgtcatcatcagttatataaccataaaagggaatctgcagcttaggagagaaaaaataaaaagaagccctagggactctactctgtccgttttcctgcttacatttatgtatttgcattctgtggcagaacacaaactgctccagc

SEQ ID NO: 179 - DNA, 2115 bp, Sus scrofa
  source 1..2115: mol_type = genomic DNA
gggtttcttcccccaaaggaagtatttcttttgcatatgcttcggagccactcttagctctggccacatagtaggttctcaaatatttgttgatagattggctcaaaaagttgcagtagtgctctacacgtggaagagacgatctagtaattagctcatttaaaataaaggttcctctttcttcaggaatatttttgaatatctgcctgattgccaaccaaaaaggcctcatcttgtcttgccctggatttatgcctaaaatgcagtcacaatggataggacgacaaaagatgaagccgtttattcaaatgggataggccatttttgagaaacagtgatttcacagcaaacgttggagtagtaaattgggtggataagcttcctggcgctgtagatcttagtctctacttgagatcgtgtataagcactgaactcaaaaaattctttttaggtttttcatgcttgcaaccaagagtatacactggaaaaaaaatgttaataggagggtagacacacactcagggtcttaaacgtaataaaattaggattagaagtaaagaaaactgtagtacttaagtctattctaaactcaaaaactggacgtctggagtaccacgtggtgtgtagaacgaacttagataaaagaactgaatggaaaaagccaagaggtcagcgcaggagcctgttcgccaggctgttggtcagcaaactgagccactcgcggattctcggccctgaagaccgccccgaggcccctgccgccgcggttccccggccttttacgcctccctctccagccggaaggggcgcggacggcaagggcggtggagaagccccggcagaggaagcggctccaggggttagtccttaacctgcgagaccgcaagactgaggaccggtggggtactgccgggtaagggctcccatctcggtccaactttgcagttaagctacgaccggttcagggaagattctggacgcctccccgccgccccaccccccagctgtgcggagagtaattcatacaaaaggaggactctcctcagccagggaaatcccagggaccgtcgataaactcccactaaacctagaaccgagtgagcgctcgaccccgcctcccacccaccagcagtcgtcatcctcctggttgagaggagcatgcgccgggcgccgtgtgctcgtcagtgggctgaacgcacatcgcccacggtccccgaagatggggggaggggacggcggtggaaccggtgccgggtggaggtggcgcggggtaaactgggaaagtggtgtcgtgtgctggctccgcccttttccccgagggtgggggaggaccatatataagcgccgtggtccccgcgaacgttctttttcgcaacgggtttgccgccaggacacaggtgagtacgggtgtggcctccgtccgcatggcctccgccggtggccacggccttagcgtgcctcccggccccccgcgcgtagagggctctgcgccctggtcctgattccgagctgcgggcggggggaggtggagaactcgaggccctccgctctcgcggttccctaccgcgtgcccggtggcggcctgctggggcgccgtggccgccgcgtgcgatccgcgccttcgcgcccgccccgtctgtcttcgcgctcgagttcggccggcagccgcgtgttactgccagggcggcccagccgaggccgcccaaggtggcctccgtgcccggcggtcccggggcagacggccgcggcggggcggggcgggcggtcggagacccagcgccccgcccgggcgggctgcgagcgcggaaagatggccgctcccggtctcaagatggaggacgcggacggcgggcggcgcacaaagggccgggcggtgctgcccgcgccgcttcccgggactcgcggcccgggtgggggaggggctgggcgccggggcggccccgttcgctgggtgtaggccgggcagggcccgcagggcgccggtgctaatgctccctggagtttgcccttggctgttggggttgtgcctgagtctccggtcgtcgggacagtagtttaaagaaggtttttgtcgtcttaggtgtcgtgaaagccatcgctaaaagctaagcaaaa

SEQ ID NO: 180 - DNA, 915 bp, Homo sapiens
  source 1..915: mol_type = genomic DNA
gttattcctaggaggttgtatagtcttctgattggaagccacaaatttcatataaactagtccaagtaattgtgctagagctaagatactcaaacctgaaatcagaagagggccatgcattggtatacacgccgcaatacagagactcagtccaaccacagcgaggatataggctatcacctgaataaccaatatggcaatgacgaaggaggttaatccaatcgctgtactaaacacatagtagtgaagtaatattaatatccctgtagaagtcacaattaaaccaaggccagtagcattctttaatgaatattcacctgggacgaaaagaatggctccaacaatgacaatgacagtgatcactagtccagcaacaagtaaagcaattgttttctcatccataccaccggatctatatttaagtgttttaataccaaactgtccccagaacaggagtatagcaaaaattgggaaaataacaataagaatattttcatttggagaaaaccatgaaacaacacgatattttagctcgatgatcgtttcaccttctctggttaattctgttacttcacaagtgtagtttcctgtgtgtgagacagcatcactcttatccatcttcaaagaggcatctccttttagtaattgtgagacttcaatttttgcactactaaagtcagtggggacagtggacttgtttagagctccatcaaaggtgtaaatatctcttcctttaaatttccactttacgtatacttcagtagtgttttgtgcctccatattagtaacaaagcatggaatgacgacagtgtcattacaaaacgtgaattctacagattttgttttattaaatagtagctgagctgatccgcagcacgccgagcccagcaacagcgccgctaccaggggccacat

SEQ ID NO: 181 - DNA, 717 bp, Homo sapiens
  source 1..717: mol_type = genomic DNA
ttaacatcgccgtccacctgtgcacaggaagatgcctacagccacaccagcaatgatgaaactgcccaccaggacgcccaggaccagcgaagtgtaggagcggcttgtttggctccctttcgtgttttccgcggaaatatgtttctgcacatactgcacacaggtgtcctccaggaattcccgcagttcataccgagtgcggttgtaggcattgagctgctgcagggtgaaggtgaccactccggaggtgacctgggtgtctgcctgccacaaggctctctccggccggaaactcacaaaggagctcccattcacagccacttcgaagaagacatgggctctagagccctcgggaggcagctcacagcccaggaagcagcggatggtcagaggaaaggccaaggtccgctcctggtgcaccaggcgcacgaggccgtggaactggagcaggtaggactgcaggccactctgcgtgcgcgcccagctctcgggctcctgcaagggctgcagctgaatgatcgtggtgttggtgtctgggccttccagcacgtgcgttaggtgtccccccagcgacgcgttgccctggtaccacacgtgataggggtcgcggaagtaggagatctggagcatatgaagtctttggaggccatctgaggcgtcttggctacaaaaggcccagccagacagcagcagtatcggcagcaatgttgtcaacat

SEQ ID NO: 182 - DNA, 2355 bp, Sus scrofa
  source 1..2355: mol_type = genomic DNA
gccatacatctgcttgaattgaaagcactcattgcagtagccgttacacttggcattgccgaaatggtcgcaggcgggggcccggcagcgctgcgtcgggggatcctctgggacgggctctggccgccgggcgccagggctcactcgttggccaaggggctggcactctatgcacagctcctggctgcagcaggccagcacgttcctgcaggtggcccgggcgcacttggacctggaagcgctctgggtggctcgcgacaagtctctgcgctggctcagcctcagctgctcttcagtcctttttgcttcatgaaatctctgattctgagcctcaatgaaacacttctgacagtatccttcaaacaccgtgcttccgagggcgccacattccctgcccaggcaggggacggcattctggaacctggaggccgtgggactggctttccccgaggcagtgacgaaatgtttattttctctgtactcaatgaaacacagcgtgcaaaagcctttgttttccggagtcccaaagtacatgcagccggcttttctgcacttgctcgtccccgtcctgtcccccggagtccgtgcggccgaggcggagcagccagagggagcctcaggcccggctctgcggcaggggtgtggggagacgctctgggccagttgcgaggggtcggacttggagcgctggtggcaggatagggggatgctggagccgaggctggaggcgggctcagccgtagtccttttaaagcaagtgctgcagatcccgttaaacgtcctggtgacgttctggaggcaggcttggcacttgctggggtcgagatggcgcgtggggtccggggggtggccggggttgagctgccgggcgttgtggcatcgctcgcagaagccgttgtgctgcacgttgagcgtgaaggggcagccggggctcctgcacttcatggccgtagtctcgctgaacaggaagaggctgggagccgtcggaggggctgagcgggggcccccagagggctcctcggggttccaggcctccccgcgggaggctccaagcgccaggccgggcagcgcctcggggtccggcttggaggtgggctttgggggtttgctttggttcttctgccgtctctctgagcactcgtggcacaagggctgggtgttcaccgacatgaagaaagggcagttgggcgtctcgcacttgatgtccatgagagaaagctggggcacggaaggctccagagggttctgagggtgcgtggctctccgcccctgctcattgttttcctgccacttcttgtactcatgctggacaagttcgaagtaatcgtctaccaggtttatttctttgggtaagttagcttcatccaactttgcagcattaattagatgggtggtgccatggtcccagccttgaacggggatttctatcaccgtcaagtactctttcaggagcttttccttcatctcattttcgggatctgtcaagaagtgaacttttaagtcttcgaatcttcctcgctctctgttaacaagtggaatagctcggatttctggcccactgtccttcagggtcaccagggggacaaagtgttggctgtcgtagccgagaacgatagggtatctgtagcattcctgggcgggccaatgcagaggcaagtaaattccgcccaccttcagaggagcgaaattagaacccgattccaaacttctcagcatcttgtctgaaatgacgatgattggcctcctgaggatgttgcaaaggacgaatatgtgtatttcttccagtgaattatactgaagtccacttcgggccactggtgtgtccgtggatgccattttgataaggttgtcccattcctcagtccaattccgggtgtcatagcaaagccccgtttccacgaattcctgagatttaagggactccagctgccagcgaaatttgaagttgcgtgtgtccgtctccttgagggtgctgaagagcgccttcctcagcaccaagtctgtgtcctgaacaccccacatgtactgggaagcagcatgcatgaggcagttcccgtccccattcgttttcagtgccacaagcttcctcacttctcgacaccagttgagcttcttctggctttccagggaggcctggatgttcctgtcgatgagagctttgtggatgatctcccgaaattgcggacaaaactggcaggttctgaacatttccagagtgtatcggtgcatggatttaaaatggtgaatgattccattggtaggtttgaaaatatcttctggagttctctctcttatcttcacagccttccgcatgttgctcaaatacaaagccaggggaaggagttgctcagccat

SEQ ID NO: 183 - DNA, 867 bp, Sus scrofa
  source 1..867: mol_type = genomic DNA
tcacatggcataaagccccatggcgaccgttgccaccagaaagctgagtgtcaggacccatcggatgagcggcacctgggagaggacgctgagctgcggcttccccctgggggttgtcacgggagtggagtcttgcacccggctgccggccctcttgcggatgtcggatgcctgcgagggtctctggtccttagtgtcctgggtcagcagctcctgcacctcctcaaacagctgaatgttgagcaggaaggcggtcttggcttcttcgaggaccctctgcttgacctcgggggtcatctccagagtgttcattcgggagcggtacagctgcttgaacttggtggcgttggcgacattggggaaagtgaagaaggccaggccctccccggagctgggcaggtccagggccttctgagcaatcttcttgaggacctggcccccagacaggtcacccatgtagcgggtgtaggcgtgggccaccagcagctcgggctcgaagcgccccacctgctgcagtcgccgcacgtagcgcttggtggcctgcgtgtaggggatggcctcctgccagcggggcccataccagaaggccatgtcctgctccagggcggcccggcggtgcagctcttccgggaagtagaggggcgtgtagaccgggttctccttgttgtgctcaatctcctcctccagggcatcgtagatgtggtacaaggacgccatcaccagcttaaagccttctcgggtgacctcgcccttctgaaagttcttcatgaactcggcattctcagcctggacgtgcacctccttggtggcctccttcagggcctctgacaaatcctggggcatgctgttgggctgtgagtgctccat

SEQ ID NO: 184 - DNA, 1146 bp, Homo sapiens
  source 1..1146: mol_type = genomic DNA
atgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttag

SEQ ID NO: 185 - DNA, 1155 bp, synthetic construct
  misc_feature 1..1155: note = CD46
  source 1..1155: mol_type = other DNA
atggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggctga

SEQ ID NO: 186 - DNA, 1152 bp, synthetic construct
  misc_feature 1..1152: note = LEA29Y-Ig
  source 1..1152: mol_type = other DNA
tcatttacccggagacagggagaggctcttctgcgtgtagtggttgtgcagagcctcatgcatcacggagcatgagaagacgttcccctgctgccacctgctcttgtccacggtgagcttgctgtagaggaagaaggagccgtcggagtccagcacgggaggcgtggtcttgtagttgttctccggctgcccattgctctcccactccacggcgatgtcgctgggatagaagcctttgaccaggcaggtcaggctgacctggttcttggtcagctcatcccgggatgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggggaagaggaagactgacgatccccccaggagttcaggtgctggggacggtggggatgtgtgagttttgtcagaagatttgggctcctgatcagaatctgggcacggttctggatcaattacataaatctgggttccgttgcctatgccctcgtagtatggcggtgggtacatgagctccaccttgcagatgtagagtcccgtgtccatggccctcagtccttggatagtgaggttcacttgatttccactggaggtgcccgtgcagatggaatcatctaggaaggtcaactcattccccatcatgtaggttgccgcacagacttcagtcacctggctgtcagcctgccgaagcactgtcacccggacctcagtatatttgcctggagatgcatactcacacacaaagctagcgatgcctcggctgctggccagtaccacagcaggctgggccacgtgcattgccatgctcgccatgcttggaaacaggagtgcaaggaccagactgagcagcgtcctctgtgtgagcagtacacccat

SEQ ID NO: 187 - DNA, 1887 bp, synthetic construct
  misc_feature 1..1887: note = hsTFPI*
  source 1..1887: mol_type = other DNA
ttaaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcat

SEQ ID NO: 188 - DNA, 2355 bp, Sus scrofa
  source 1..2355: mol_type = genomic DNA
atggctgagcaactccttcccctggctttgtatttgagcaacatgcggaaggctgtgaagataagagagagaactccagaagatattttcaaacctaccaatggaatcattcaccattttaaatccatgcaccgatacactctggaaatgttcagaacctgccagttttgtccgcaatttcgggagatcatccacaaagctctcatcgacaggaacatccaggcctccctggaaagccagaagaagctcaactggtgtcgagaagtgaggaagcttgtggcactgaaaacgaatggggacgggaactgcctcatgcatgctgcttcccagtacatgtggggtgttcaggacacagacttggtgctgaggaaggcgctcttcagcaccctcaaggagacggacacacgcaacttcaaatttcgctggcagctggagtcccttaaatctcaggaattcgtggaaacggggctttgctatgacacccggaattggactgaggaatgggacaaccttatcaaaatggcatccacggacacaccagtggcccgaagtggacttcagtataattcactggaagaaatacacatattcgtcctttgcaacatcctcaggaggccaatcatcgtcatttcagacaagatgctgagaagtttggaatcgggttctaatttcgctcctctgaaggtgggcggaatttacttgcctctgcattggcccgcccaggaatgctacagataccctatcgttctcggctacgacagccaacactttgtccccctggtgaccctgaaggacagtgggccagaaatccgagctattccacttgttaacagagagcgaggaagattcgaagacttaaaagttcacttcttgacagatcccgaaaatgagatgaaggaaaagctcctgaaagagtacttgacggtgatagaaatccccgttcaaggctgggaccatggcaccacccatctaattaatgctgcaaagttggatgaagctaacttacccaaagaaataaacctggtagacgattacttcgaacttgtccagcatgagtacaagaagtggcaggaaaacaatgagcaggggcggagagccacgcaccctcagaaccctctggagccttccgtgccccagctttctctcatggacatcaagtgcgagacgcccaactgccctttcttcatgtcggtgaacacccagcccttgtgccacgagtgctcagagagacggcagaagaaccaaagcaaacccccaaagcccacctccaagccggaccccgaggcgctgcccggcctggcgcttggagcctcccgcggggaggcctggaaccccgaggagccctctgggggcccccgctcagcccctccgacggctcccagcctcttcctgttcagcgagactacggccatgaagtgcaggagccccggctgccccttcacgctcaacgtgcagcacaacggcttctgcgagcgatgccacaacgcccggcagctcaaccccggccaccccccggaccccacgcgccatctcgaccccagcaagtgccaagcctgcctccagaacgtcaccaggacgtttaacgggatctgcagcacttgctttaaaaggactacggctgagcccgcctccagcctcggctccagcatccccctatcctgccaccagcgctccaagtccgacccctcgcaactggcccagagcgtctccccacacccctgccgcagagccgggcctgaggctccctctggctgctccgcctcggccgcacggactccgggggacaggacggggacgagcaagtgcagaaaagccggctgcatgtactttgggactccggaaaacaaaggcttttgcacgctgtgtttcattgagtacagagaaaataaacatttcgtcactgcctcggggaaagccagtcccacggcctccaggttccagaatgccgtcccctgcctgggcagggaatgtggcgccctcggaagcacggtgtttgaaggatactgtcagaagtgtttcattgaggctcagaatcagagatttcatgaagcaaaaaggactgaagagcagctgaggctgagccagcgcagagacttgtcgcgagccacccagagcgcttccaggtccaagtgcgcccgggccacctgcaggaacgtgctggcctgctgcagccaggagctgtgcatagagtgccagccccttggccaacgagtgagccctggcgcccggcggccagagcccgtcccagaggatcccccgacgcagcgctgccgggcccccgcctgcgaccatttcggcaatgccaagtgtaacggctactgcaatgagtgctttcaattcaagcagatgtatggc

SEQ ID NO: 189 - DNA, 867 bp, Sus scrofa
  source 1..867: mol_type = genomic DNA
atggagcactcacagcccaacagcatgccccaggatttgtcagaggccctgaaggaggccaccaaggaggtgcacgtccaggctgagaatgccgagttcatgaagaactttcagaagggcgaggtcacccgagaaggctttaagctggtgatggcgtccttgtaccacatctacgatgccctggaggaggagattgagcacaacaaggagaacccggtctacacgcccctctacttcccggaagagctgcaccgccgggccgccctggagcaggacatggccttctggtatgggccccgctggcaggaggccatcccctacacgcaggccaccaagcgctacgtgcggcgactgcagcaggtggggcgcttcgagcccgagctgctggtggcccacgcctacacccgctacatgggtgacctgtctgggggccaggtcctcaagaagattgctcagaaggccctggacctgcccagctccggggagggcctggccttcttcactttccccaatgtcgccaacgccaccaagttcaagcagctgtaccgctcccgaatgaacactctggagatgacccccgaggtcaagcagagggtcctcgaagaagccaagaccgccttcctgctcaacattcagctgtttgaggaggtgcaggagctgctgacccaggacactaaggaccagagaccctcgcaggcatccgacatccgcaagagggccggcagccgggtgcaagactccactcccgtgacaacccccagggggaagccgcagctcagcgtcctctcccaggtgccgctcatccgatgggtcctgacactcagctttctggtggcaacggtcgccatggggctttatgccatgtga

SEQ ID NO: 190 - DNA, 5000 bp, Bos taurus
  source 1..5000: mol_type = genomic DNA
gagttcactcagactcacgtccatcgagtccgtgatgccatccagccatctcatcctctgtcgtccccttctcctcctgcccccaatccctcccagcatcagagtcttttccaatgagtcaactcttcgcatgaggtggccaaagtactggagtttcagctttagcatcattccttccaaagaaatcccagggctgatctccttcagaatagactggttggatctccttgcagttcaagggactctcaagagtcttctccatcaccacagttcaaaagcatcaattcttcggtgctcagccttcttcacagtccaactctcacatccatacatgaccacaggaaaaaccatagccttgactagatggacctttgttggcaaagtaatgtctctgcttttgaatatgctatctaggttggtcataactttccttccaaggagtgagcgtctttgaatttcatggctgcagtcaccatctgcagtgattttggagcccaaaaaaataaagtctgacactgtttccactgtttccccatctatttcccatgaagtgatggggccggatgccatgatcttcgttttctgaatgttgagctttaagccaactttttcactcttcactttcactttcatcaagaggcttttgagttcctcttcactttctgccgtaagggtggtgtcatctgcatatctgaggttattgatatttctcccggcaatcttgattccagcttgtgtttcttccagtccagcgtttctcatgatgtactctgcatagaagttaaataaacagggtgacaatatacagccttgatgtactccttttcctatttggaaccagtctgttgttccatgtcctgttctaactgttgcttcctgacctgcatacaaatttctcaagaggcagatcaggtggtctggtattcgcatctctttcagaattttccacagtttattgtgatccacacagtcaaaggctttggcatagtcaataaagcagaaatagatgtttttctggaactctcttgctttttccatgatccagcggatattggcaatttgatctctggttcttctgccttttctaaaaccagcttgaacatcaggaagttcatggttcacatattgctgaagcctggcttggataattttaagcattactttactagcatgtgagatgagtgcaatttcaagtaatagataatagtatttgtgctcaatacatcaacttctaaaagaccttgagatttacaaataattctaaagtcaaatggggacattacagggatattgatttcagctgaatgtaagcgatactttattgaaacttgaggggtttaatagaataaattgccttgtgaatagtgattcccttgacaccagtgctacacgagtgagtatgacctgtgagagatactatagcgtaagaatcctaaattagaagaaattaggatgaccttgaggaggccctgtgcatacatgctaagtcacttcagtcatgtccgacttccagacccagggatcaaatccatgtcttctgtggctcctgcattgcaggtggattctttaccactgagccacctgggaagcccctgtggggccctcctaaatccaaaattccatgatttttatttatttattttggctgcactgggtcttggttgtagcatgtgggatctttttagctgcagcatgtgggatctagttccctgaccagggatcaaacccaggccccctgcatttggagcttggggtcttagccactgcaccatgaaggaactcccccaaagtccatgattttaaagtcagacaattaaagattgacctgaagcagagggatggtttctgagctaagaaatggagctccagggttctgattattccaactttcaaccactccccaagtatatttacattaactactaaatgtaagatatcccaagtgaatacacatgtgtgccatttggaataacattcattacagcatctaagaacttcctaaaagcttttaaggaagatttgctgattattttcattgtaaaagaattattgattttgtaacatcatgttttacaaatatggatagaaataacaaaacataagagaaaaaaaacagagagataaattaatctgcaattttagtcggagattttaaaactcatttttcagtacttaagggtgtaaataggcttcctccccaaaaatcatctttgttgttaatttcttaattttcattagaggacatcctccatattaattcaatattgttaaatgctttgatacttgttttctgtttctgaaatacttggaaattaagcaacataattctaaattgccatagttaaagaagaaatcccaaagaaatttggaaaatatttgaactcgaggataatgaaatcacaaaatatcaaaatttgtagcatgtagctaaagcactgattaaaagaaaacttatacctttaaatcttatatttgaaaagaataaagctctaaagtagtaatctaaaaatccacttaaagaatataggcttttaaagacaaaaacttaaagtgagtagtaaagtagaaataataaagttatgagcaaaatttaacagacaatagagttactttgaacactaagcattgatttatagatcactagttacttagccaaggtgcttgggtgactaaaaacaactttaaaactgccctttgaagtgcatttagaaagaaaaagaaacgttcaagccgccattagggaagcagagtgtgatttaattcctttggaaaaacacagagcaccccacagttccatgcaaaaatagctgaagcttctcgcgtgctgtaatgtgtcaataactttagaaacctcatttcatttactcctcacccaagccttatgaggcaatattattatctctattttgtaggtgagcaaactgggtctcggggaggttaagtaatttcttcctgagcataagttcaagtccaggtccttctgattctttcccttattccaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagctttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaacta

SEQ ID NO: 191 - DNA, 1190 bp, Homo sapiens
  source 1..1190: mol_type = genomic DNA
taagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccct

SEQ ID NO: 192 - DNA, 2775 bp, synthetic construct
  misc_feature 1..2775: note = spolyA
  source 1..2775: mol_type = other DNA
taataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcttattaaagcagctgggacagggacagaaaaagggctttgactgcctttctcttgagcccttttcctgatctccacaactcactgataccactggtctcattggaaggggtgggctgttaacagtgtgacaaatgtaggaataaactggatgcaaaagggggctttgtgcagctttatattcactgttgtcttaaaccctttttatggactcaaatcaaatgacagtccctcaggatgttagcttctgaattcagaaagtgattgcagagttgcccactcctttatcctgtgtctgatggttttgctgtctctgtagtgattagcttactgtcaccatttcctcattcaataggcactcaggtggatgaaaggttctggttcactccccaaatacctgcaacagtcaggagtgtgtcaggccaaaaccagaaaacaggaattgccatggggtctccatgatgggtggcagggactcaagtacatgagccatattcggctgcttccaggtacattagcagaaaactagatcagaagtggagctgtggggaccagaataaacactttgatatgggatgttggtgtctcaagtagcaacttaaccccctgctcactaaaacactctaatcctcattacctaggagcaactgagcctgagggctatctaatatagctggtgacacagagatcatataccctggctaaaagcatggctgaatccatgaaagaaaatatatgctcaaaataggaatagaatacacagatttatgcacagatgcttacaaattttagccaatcctgatgacatggttaacttggagatctagatcagttcttgccagcatgcccagagaatagtacatgggaaaatttatagagatgatgagttagagacaaagtgagtgataatgacattgcctgggattgctgctaggtacactgaaaaatcagggaggaagatccaataaatgacccattcaaaatctagaaaacctgtcaacaggaactttggaaacttatttctaatttatctgttcatcaaggcagcaataagtctttctgtaaaatcattaaatatgcccaaatgtcaagttctatgtgagtcatgaaggtaacttgataatgctctacacttcatattttgttcaattgtttaatacaaaaagcacttttattttatttatttaattttttaaacgtttatttaataaatataaatttccaaattacagcttatagattacaatggcttcaccctcataacttccctcccacctgcaaccctcccatctcctgctccctctcccattccattcacatcaagattcatttttaattatctttatatacagaagatcaatttagtatatattaagtaaagattttaacagtttgcacccacacagaacataaagtataaatactgtttgagtactagttatagcattaattcacattgaacaacacattaaggacagagatcctacatgaggagtaagtgcacagcgactcctgtcgttgacttaacaaattgacattcttgtttagggggtcagttatctccccaggctcctgtcatgagttaccaaggctatggaggccttttgagttcactgacttcgatcttatttagacaaggtcatagtgaaagtggaagtccactcctccctttagagaacggtacctccttcctcaatggcccattctttcaactgggatctcgctcacagagatctttcatttagctcatttaactcctttttttttttttttttctagagcatcttacctttccattgcctgaaatactttcatgggctcttcagccagatgtgaatgccttaagggctgattctgaggccagagtgctgtttaggacatgtgccattctatgagtctgatgtgtatcccatttcccatgttggaatgttctctccatttttaattctgtcagttagtattagcagacactagtcttgtttatgtgatccctctgactcttatgcctatcattacgatcaattgtgaacagaaattgatcactgggactagtgagatggcattggaacatgccacctcaatgggattgaattcgaatcccctggtctgtttctaactctaccatttgaggtaagtcagtttgagcatgtcccgaattgcacatctcttccctctcttattcccactcttatatttaacagggattacttttcagttaaatttaaacacctaagaataattgtgtgttaattacagagttcaaccaatagtattaagtagaacaaccaaaaaatactaaaagggataaagtattacattgtacatcaacagtcaggacaagggctgttcaagtcactgtttctcatagtgttcatttcactttgacaggtttcc

SEQ ID NO: 193 - DNA, 674 bp, synthetic construct
  misc_feature 1..674: note = UCOE
  source 1..674: mol_type = other DNA
gggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgttaagtgccgcggtcgtcggcgcctccgccctcccccttgggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcc

SEQ ID NO: 194 - DNA, 561 bp, synthetic construct
  misc_feature 1..561: note = IRES
  source 1..561: mol_type = other DNA
cccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataat

SEQ ID NO: 195 - DNA, 463 bp, synthetic construct
  misc_feature 1..463: note = IRES
  source 1..463: mol_type = other DNA
agggtcattaattgtaaaggaaaggtgccgacctccggtcacctattcaggcatagaagctttttaaaccgagcgcttttatagaagccccagtccccttctcagatcccgagtgtcgcgtgttacctcggggtacctgaagggcatccttagcctgtcaccagtgtgtgggtaccagtttcaatgtcactttaaagtgggtttcgcagtaaagtcgccgtgctggggttgcacacatgacgggcccgtgtgggcgtggcttttggccccgtgggtccttgttaccaaggaggagttcccacggccgtcatgctccgctacgaagcaacagtgctgttactaacactcgccagtggatcgagcgtggagccaaacacagtacaaagtgttacccctctagacctggaaagaccaggcggagtttcaagttgcacgttttgtgtcagttggggaaacctgctta

SEQ ID NO: 196 - protein, 357 aa, synthetic construct
  REGION 1..357: note = CTLA-4
MHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPCPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 197 - protein, 9 aa, synthetic construct
  REGION 1..9: note = peptide epitope
VMAPRTLIL

SEQ ID NO: 198 - protein, 9 aa, synthetic construct
  REGION 1..9: note = peptide epitope
VMAPRTLFL

SEQ ID NO: 199 - protein, 124 aa, Homo sapiens [sequence omitted]

SEQ ID NO: 200 - DNA, 1134 bp, synthetic construct
  misc_feature 1..1134: note = CD46 splice variant
  source 1..1134: mol_type = other DNA
atggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctctga

SEQ ID NO: 201 - DNA, 27914 bp, synthetic construct
  misc_feature 1..27914: note = 14M
  source 1..27914: mol_type = other DNA
cggggacagcccccccccaaagcccccagggatgtaattgcgtccctctcccgctagggggcagcagcgagccgcccggggctccgctccggcccgacgctccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccagcagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcctatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagcggcatccctgcaagggatcctcacccccttttcttccttcattctctgctggtgtcaatcacagcttctagcagagggaaggcaggccaggcttggtttcttcttgcgagagtatttaactcagggccctgtagaacaatgagaatctgacctgcaactagctgggcgtgctggggcatgcctgtgtagtttcagctacttgggaggctgaggcaggagaattgcttgagcccaaagttgaggctgcagtgagccatggttgtgccattacactccagcctgggcaacacaagacccctgctcagaaataaaaagagaacctggcctgcagtgccaggcaggccctgaggtccaggagcctgggtatctccctctgcagcatgggtcacgaacaaactgggccctcagaggccacgggatggcgcccagtctccagtcacaaggcagaatccagacctcagcccatagctaaccagagctgtctgcaggccagatatggccccatggaccccctaccccaacttgactttgattccaggtccccctctgtctggatgaacaggtaggaattgcggcctctcctaagcctatgggagcctgggccaggctgaccctcaaggctgacagccacgatcccataggtgaaggcaaaggcgtggcagctaggaacacccactacacccccactcaagggaacaccgtgcccagctaccctgagacagccccactcccaggaaatgcaggtgccaaccagccccagtgaggcatggcacctgagccagacacccccaaatagtcccttcccacctcctcaagcatctgcactctgggtgaacccagaaaaactggggtacctggggagacatagaagggccaggccaggaactccccaataagcaggaacaggaacctgacccctgagcctcccccaccctctaaggctgctcaatgtcaaggcaggagggatctccacacacctgcactctgggtaaggacaagttggcccccactgccccacccttttgcagggttcaccctcctgcagggttcaccctctgctgcccccaacccagccacaccacaaagtcacacttggcctcaagagaaatgttctggcacctgcacttgcactggggacagcctattttgctagtttgttttgtttcgttttgttttgatggagagcgtatgttagtactatcgattcacacaaaaaaccaacacacagatgtaatgaaaataaagatattttattttacgtctcctccaaatgtgtatcactttgcttctttgagtttgtatcttggatgccacattttttcacatccatcattctcccttttcttaaacggaagatgaatgtcagtgctacaccaaggcataataagatggctcccagaattaccaagtgagtcctttcatttggaggatgtgccagaggtagttctgggatgaccaattcagctgtatggttttcctcaggatctaatctcctaaaagtgcagtagaaaatctcattagttgttgtgttgattctcagtgtgctggtcacattgaaaagcttctcctctctcttggaattggtggtggtggtcttaccactcaggacttgatggtcactgcttgtccagatgacttcggccttggggtagccctcagcctgacatgtcagttcatgttcagaggtgactggatccacaaccaaaattctttggttgattttgttgtatggggcattgactttcacagtaattcgcttgtagtcggcaccaccatagctgatcatgcagcggtacacccctgcatcctgcaatttcacatctgtgatctgaagtgcagcatttcccagggagagctggtccttcaacagccgggccctctgtctgtagctactatgctgaaccttcaggtcttcctctccatgcacaaattgaataatgttcttatcctccatttcccaatagacaattagtgcagccaggtctaattgtttttctactgggaatttgcattcaattgtcatattgctaccatactctaccacatataggtccttgggaaccgtgacagtaaatgcgttcagcaaatgccagtaggtcatgaatataaagacagcaaatatcctcataggtccaggattctcctcgacgtcaccgcatgttagcagacttcctctgccctctccgcttcccatggcataaagccctacagcaactgtcgccaccagaaagctgagtgtaaggacccatcggagaagcggagcctgggagcgggtgttgagtgggggcttccctctgggagtctccacgggggcagaatcttgcactttgttgctggcccgctggcgaagccctggtgcccgtgaggggctctggtccttggtgtcatgggtcagcagctcctgcaactcctcaaagagctggatgttgagcaggaacgcagtcttggcctcttctatcaccctctgcctgactgcgggagtcatctccagggagttcatgcgggagcggtagagctgcttgaacttggtggcactggcaatgttggggaaggtgaagaaggccaggccctcgccagagctgggcaggtccagggctttctgggcaatctttttgagcacctggcccccagacaggtcacccaggtagcgggtgtaggcgtgggccaccagcagctcgggctctgtgcgccccacctcgtggagccgcttcacatagcgctgcatggctggtgtgtaggggatgacctcctgccagcggggcccgtaccagaaggccaggtcctgctccagggcagccttgcggtgcagctcttctgggaagtagacaggggcgaagactgggctctccttgttgcgctcaatctcctcctccagggccacatagatgtggtacagggaggccatcaccagcttgaagccgtctcgggtcacctggcccttctgaaagttcctcatgaactcagcattctctgcctgggtgtgcacctccttggtggcctccttcagggcctctgacaaatcctggggcatgctgtcgggttgcggacgctccataggcccggggttctcctcgacgtcaccggcctgtttcagtagtgagaaattggtggcgccgctgccgccatacatctgcttgaactgaaagcattcgttgcagtagccgttgcacttggcattgccaaaatgatcacaggcgggggcccggcaacgctgcttgggggggtcttcgggggcaggctcaccccggtgggccccagggcccatcctctggttgggatgctgacactccatgcagagctcctcgctgcggcaggccaggatgttcttgcaggaggcccgggcgcacttgggccttgaggtgctttgtgtggttcgaggcacatctctgcgctggctcgatctcagttgctcttctgtccttttggcctcatgaaatctctgattctgagcttcaatgaaacacttctggcagtatccttcaaacatggtgcttccaagggtgccgcattccctccccaggcacggaatggtgttctggaacctggacgctgtgggactgactttccctgaggcagcagcaaaatgtttgttttctctgtactcgatgaaacacagtgtgcaaaagcccttgttttctggagtcccaaaatacacgcagccggcttttctgcacttgctcgtccccgtcctgtccccaggagtccgtgcagcttgagacaggcagccagcaggggcgtcgtttccagctctgtggcaagaatgcggggaggggctccggacgagccgcgagggatctgacttggaacgctggtgacaggaaggagggaggctggtgctgaggctggaggaggcctctgctgtagtccttttgaagcaagtactgcagatcccattaaatgtcctggtaacatcctggaggcaggcttggcacttcccgggatccaagtgccttgtgtggtctggggcgtggctggcgtgaagttgccgggcgttgtggcaacgttcacaaaatccgttgtgctgcacattcagtgtgaaggggcagccggggctcctgcacttcatggcagtggtctcactgaacagaaaagggctgggtgctgtcggtggggccgaatgaggccccccagtggactcctcagggttccacgccaagggctcataggcttctccccgagaggccccgagcgccatgccagggagcccctcagggcccggcttggagttcagctttgggagtttgttttgattcttttgccgcctctctgagcactcatggcataaaggctgggtgttcacagacatgaagaaggggcagttgggcgtttcacattttacatccatgagagaaagctggggcacggaaggttccatgggattctgggcgtgcccctctctcctcccctgctcgctgttttcctgccatttcttgtactcatgctgaacaagttcaaagtaatcatctaccagattgatttcttttggtaagttagcttcatccaactttgcggcattgatgagatgagttgtgccatggtcccagccttggacggggatttctatcaccattaagtactcttttaagagcttctccttcatctcattttcaggatctgtcaaaaagtgaacttttaagtcttcaaatcttccccggtctctgttaacaagtggaacagctcggatttcaggcccactgtccttcagggtcaccaagggtacaaaatgatggctgtcatagccgagaacaatggggtatctgtagcattcctgggcaggccagtggagaggcaagtaaattccacccactttcaaaggggcgaaattggaacctgattccaaacttcttagcattttgtctgaaatgacaatgattggccttctgaggatgttgcaaaggacaaatatgtgtatttcttccagtgagttgtactgaagtccacttcgggccatgggtgtgtctgtggaagccattttgataagattgtcccattcatcattccagttccgagtatcatagcaaagccccgtttcaacaaattcctgagatttgagagactccagttgccagcggaatttaaagttgcgtgtgtctgtttccttgagcgtgctgaacagcgccttcctcagtaccaagtctgtgtcctgaacgccccacatgtactgagaagtggcatgcatgaggcaattgccgtcaccgttcgttttcagcgccacaagcttccggacttctcgacaccagttgagtttcttctggctttccagggtggcctggatgtttctgtcgatgagggctttgtggatgatctcccgaaactgaggacaaaactggcaagttctgaacatttccagtgtgtatcggtgcatggttttaaaatgatgaatgatcccattagtaggtttaaaaatgtcttctggagttctctcccgtatcttcacagctttccgcatattgctcaaatacaaagcctgaggaaggacttgttcagccatggttgtggccatataatcatcgtgtttttcaaaggaaaaccacgtccccgtggttcggggggcctagacgttttttaacctcgactaaacacatgtaaagcatgtgcaccgaggccccagatcagatcccatacaatggggtaccttctgggcatccttcagccccttgttgaatacgcttgaggagagccatttgactctttccacaactatccaactcacaacgtggcactggggttgtgccgcctttgcaggtgtatcttatacacgtggcttttggccgcagaggcacctgtcgccaggtggggggttccgctgcctgcaaagggtcgctacagacgttgtttgtcttcaagaagcttccagaggaactgcttccttcacgacattcaacagaccttgcattcctttggcgagaggggaaagacccctaggaatgctcgtcaagaagacagggccaggtttccgggccctcacattgccaaaagacggcaatatggtggaaaataacatatagacaaacgcacaccggccttattccaagcggcttcggccagtaacgttaggggggggggttattcatcattcatcattccttttgattctttgaatgcattaaggggttcctctacagctttcctaggaggttgtatagtcttctgattggaagccacaaatttcatataaactagtccaagtaattgtgctagagctaagatactcaaacctgaaatcagaagagggccatgcattggtatacacgccgcaatacagagactcagtccaaccacagcgaggatataggctatcacctgaataaccaatatggcaatgacgaaggaggttaatccaatcgctgtactaaacacatagtagtgaagtaatattaatatccctgtagaagtcacaattaaaccaaggccagtagcattctttaatgaatattcacctgggacgaaaagaatggctccaacaatgacaatgacagtgatcactagtccagcaacaagtaaagcaattgttttctcatccataccaccggatctatatttaagtgttttaataccaaactgtccccagaacaggagtatagcaaaaattgggaaaataacaataagaatattttcatttggagaaaaccatgaaacaacacgatattttagctcgatgatcgtttcaccttctctggttaattctgttacttcacaagtgtagtttcctgtgtgtgagacagcatcactcttatccatcttcaaagaggcatctccttttagtaattgtgagacttcaatttttgcactactaaagtcagtggggacagtggacttgtttagagctccatcaaaggtgtaaatatctcttcctttaaatttccactttacgtatacttcagtagtgttttgtgcctccatattagtaacaaagcatggaatgacgacagtgtcattacaaaacgtgaattctacagattttgttttattaaatagtagctgagctgatccgcagcacgccgagcccagcaacagcgccgctaccaggggccacataggtccagggttctcctccacgtctccagcctgcttcagcaggctgaagttagtagctccgcttcccaagctgtgagactcagacccctgggcactgtcgctccactcagccttagagtagctccctccttttccacctgagctcttcttcctccatatcacagcagcaaccacagctccagagaccacagatccaaggagaaccaggccagcaatgatgcccacgatggggatggtgggctgggaagccggcttccatctcagggtgacgggctcgggtagcccctcatgctgcacatggcacgtgtatctctgctcctctccagaaggcaccaccacagctgcccacttctggaaggttccatcccctgcaggcctggtctccacgagctccgtgtcctgggtatggccctccccatcctgctgccaggtcagtgtgatctccgcagggtagaagcccagggcccagcacctcagggtggcctcatggtcagagatggggtggtgagtcacgtgtgtctttgggggctccaggtgaagcagcgtctccttccccttctccaggtatttgtggagccactccacgcatgtgtcttccaggtaggctctctggtgctccgcctcagaggcatcatttgacttttgctcggagatctgagccgccgtgtccaccgcggtccaggagcgcaggtcctcattcagggtgagataatccttgccgtcgtaggcgaactgttcatacccgcggaggaagcgcccgtcgggccccagctcgcagccatgcatccactgcagggtgtgagacccggcctcgctctgattgtagcagccgcgcagcgtccgcagattcactcggaaaatctgtgcggtgtccctggcgctccgtgtctcccggtcccaatactctgacccctcctgctccatccacggcgcccgcggcaccatcctcggactcgcggcgtcgttgtcgaagcgcacgaactgggtgtcgtccacgtagcccacagagatgaagcggggctccccgcggccgggccgggacacggaagtgtggaaatacttcaaggagtgagatccggaaccgccaccaccgcttcctccgccgccactaccgccaccaccagaaccgccaccacccatgtcgcgatcccacttaactatcttgggctgtgacaaagtcacatggttcacacggcaggcatactcatctttttcagtgggggtgaattcagtgtagtacaagagatagaaagaccagtccttgctgaaagacaagtctgaatgctccactttttcaattctctctccattcttcagtaagtcaacttcaatgtcggatggatgaaacccagacacatagcaattcaggaaatttgactttccattctctgctggatgacgtgagtaaacctgaatctttggcgtacgctggatggagccgccaccaccagaaccgccaccaccggaagcgccgcaacctaaaattaaagtccgcggagccatagcctcgaggccagaaagagagagtagcgcgagcacagctaaggccacggagcgagacatggtggccaaccagcacgttgcccaggagctgtaggaaaaagaagaaggcatgaacatggttagcagaggctctagagccgccggtcacacgccagaagccgaaccccgccctgccccgtcccccccgaaggcagccgtccccctgcggcagccccgaggctggagatggagaaggggacggcggcgcggcgacgcacgaaggccctccccgcccatttccttcctgccggcgccgcaccgcttcgcccgcgcccgctagagggggtgcggcggcgcctcccagatttcggctccgccagatttgggacaaaggaagtccctgcgccctctcgcacgattaccataaaaggcaatggctgcggctcgccgcgcctcgacagccgccggcgctccggggccgccgcgcccctcccccgagccctccccggcccgaggcggccccgccccgcccggcacccccacctgccgccaccccccgcccggcacggcgagccccgcgccacgccccgcacggagccccgcacccgaagccgggccgtgctcagcaactcggggaggggggtgcaggggggggttacagcccgaccgccgcgcccacaccccctgctcacccccccacgcacacaccccgcacgcagcctttgttcccctcgcagcccccccgcaccgcggggcaccgcccccggccgcgctcccctcgcgcacacgcggagcgcacaaagccccgcgccgcgcccgcagcgctcacagccgccgggcagcgcgggccgcacgcggcgctccccacgcacacacacacgcacgcaccccccgagccgctcccccccgcacaaagggccctcccggagccctttaaggctttcacgcagccacagaaaagaaacgagccgtcattaaaccaagcgctaattacagcccggaggagaagggccgtcccgcccgctcacctgtgggagtaacgcggtcagtcagagccggggcgggcggcgcgaggcggcgcggagcggggcacggggcgaaggcaacgcagcgactcccgcccgccgcgcgcttcgctttttatagggccgccgccgccgccgcctcgccataaaaggaaactttcggagcgcgccgctctgattggctgccgccgcacctctccgcctcgccccccccccccccccgccccgccccgccccgcctggcgcgcgccccccccccccccccgcccccatcgctgcacaaaataattaaaaaataaataaatacaaaattgggggtggggaggggggggagatggggagagtgaagcagaacgtggggctcacctcgacccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgacgctggccctccgcgcctacagctcaagccacatccgaagggggagggagccgggagctgcgcgcggggccgccggggggaggggtggcaccgcccacgccgggcggccacgaagggcggggcagcgggcgcgcgcgcggcggggggaggggccggcgccgcgcccgctgggaattggggccctagggggagggcggaggcgccgacgaccgcggcacttaccgttcgcggcgtggcgcccggtggtccccaaggggagggaagggggaggcggggcgaggacagtgaccggagtctcctcagcggtggcttttctgcttggcagcctcagcggctggcgccaaaaccggactccgcccacttcctcgcccgccggtgcgagggtgtggaatcctccagacgctgggggagggggagttgggagcttaaaaactagtacccctttgggaccactttcagcagcgaactctcctgtacaccaggggtcagttccacagacgcgggccaggggtgggtcattgcggcgtgaacaataatttgactagaagttgattcgggtgtttccggaaggggccgagtcaatccgccgagttggggcacggaaaacaaaaagggaaggctactaagatttttctggcgggggttatcattggcgtaactgcagggaccacctcccgggttgagggggctggatctccaggctgcggattaagcccctcccgtcggcgttaatttcaaactgcgcgacgtttctcacctgccttcgccaaggcaggggccgggaccctattccaagaggtagtaactagcaggactctagccttccgcaattcattgagcgcatttacggaagtaacgtcgggtactgtctctggccgcaagggtgggaggagtacgcatttggcgtaaggtggggcgtagagccttcccgccattggcggcggatagggcgtttacgcgacggcctgacgtagcggaagacgcgttagtgggggggaaggttctagaaaagcggcggcagcggctctagcggcagtagcagcagcgccgggtcccgtgcggaggtgctcctcgcagagttgtttctcgagcagcggcagttctcactacagcgccaggacgagtccggttcgtgttcgtccgcggagatcgatctctctcatctcgctcggctgcgggaaatcgggctgaagcgactgagtccgcgatggacgtaacgggtttgaaatcaatgagttattgaaaagggcatggcgaggccgttggcgcctcagtggaagtcggccagccgcctccgtgggagagaggcaggaaatcggaccaattcagtagcagtggggcttaaggtttatgaacggggtcttgagcggaggcctgagcgtacaaacagcttccccaccctcagcctcccggcgccatttcccttcactgggggtgggggatggggagctttcacatggcggacgctgccccgctggggtgaaagtggggcgcggaggcgggaattcttattccctttctaaagcacgctgcttcgggggccacggtgtctcctcggtgcctgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagccaccatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgactggcagtggagccaccaacttctcactccttaagcaggctggcgacgtggaggagaaccccgggcctatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaatagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattcgttttgtgcagaaattttaaggtgactacacgcttagcccaactacccttgggaaatgtgtgtgtgttagtcactcaatcgtgtccagctctttgtgaccccatggactgtagcctgccaggctcctctgtccatgggattctccaggcaagaatactggagtgggttgccattccccaggggattttcccaacccaaggatcaaacccgagtttcctgcattgcaggcagattctttactctctgagccatcagggaagccctgtgggaaatgggaaccatgcaaaaacggctttgggaccaataagaccagaatatttgggatctgaactggcgcaagaaatgtggaagagagattctaaatgcatgtgtacatactaagttgcttcagtcatgtccgactatttgcaaccccatggaccacagcctgccaggctcctctgtccatgggattctccagtcaagaatactggagtgagtttccatttcctcttccaggggatcttccagacccagggatcaaaccagtgtctcttatgtctcctgtgttgacaggcaggttctttaccactagtgccacctgagacccaattctaaacgaggggttgcaaattcagtgccaacaggtgccaggtataagtggcaagggctgcatgtgaagggagaaatagcaaccagcccttaggctgcttgtgaaggatacagcacagaggggtgggaaccagggcagcctgaagtctcaggccccagctaaggatgtggcccagccagccttgttacattgcctgatcctgcattcaggactgcaggaggactttcctggtggtccagtggttgagaatccacatgccaatgcaggggacacgggttcaatccctgatctgggaagattccacatgcctcagggcaactacgcccgtacatcacaactaccgaagccctcgcacctagagcctgtgctctgcaacaggagaagccactcagggagaagcctgctcaccacaactagaaagtacagtagcccctgctcgctgcaactggagaaagccctcttgcagcaaccaacacccagcacagccaaaactaaatatatatatattttaaaagacctcaggggacttccctggtggttcagcgtgtaaggctctgtgtttccaatggagggggcccaggttcaacccctggttggagaactagatccctcatgctgaaattaaagatcccaagtgctgcaacctgactcagccaaaaaaaaaaaaaaaaagctcagatgcagggctgccagaccttctgattctttgagacagacagggtatctagactttcatgtaaaatcaaatgtttacacattggcaactaattcatagtgaaaacattttaagggcaaaatttaacccaaacacatttgctcttcaagctgtcagtgagcaatttgttattagaggaatggattgggataacttttttgtttatggtgtaagacaagggtctgatttcatttcattttgagggtttcaccctctcatataataaaattcttctatatacccttctatcatcacttattactgattatatgccttgatttcagaatcttgccaactagattcagaatttgactgggagagaggacaaggaccacttgagactcatattttatttccagaatctagcatctacctacctaggtattgaataagaaaaatgaagttaaggtggttgatggtaacactatgctaataactgcagagccagaagcaccataagggacatgataagggagccagcagacctctgatctcttcctgaatgctaatcttaaacatcctgaggaagaatgggacttccatttggggtgggcctatgacagggtaataagacagtagtgaatatcaagctacaaaaagccccctttcaaattcttctcagtcctaacttttcatactaagcccagtccttccaaagcagactgtgaaagagtgatagttccgggagactagcactgcagattccgggtcactgtgagtgggggaggcagggaagaagggctcacaggacagtcaaaccatgacccctgtttttccttcttcaagtagacctctataagacaacagagacaactaaggctgagtggccaggcgaggagaaaccatctcgccgtaaaacatggaaggaacacttcaggggaaaggtggtatctctaagcaagagaactgagtggagtcaaggctgagagatgcaggataagcaaatgggtagtgaaaagacattcatgaggacagctaaaacaataagtaatgtaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttggggaacaaaggaacctttaatagaaattggacagcaagaaagcgagcttactataccatatctttccagaaatatgaaggcttgtgaaagataagcaagcctatgatggccactgtgaaaaggaccagggagaatagaaccatgaggaagacataggtggagtgggagagaggtgtggacaatggttgctcagctgggatcatgttggtcaggttcagcatgtagcccaaagtccagccggcgtcgctgccctggatcttgccaatgaaatggatgtgctcccaggaatcagctgtgaaatgatagccttgcagaaggagggagagaatgtaggtaccagaaaagcagtattcactcaggtacttctcctttactccagcgtaagatgtttttatctcctcccaaggctgagcacagaactttttcatcatctcagtcaccttttcctgagagactttctctgatgtcaagtttaaaaacttcatcacaaagtaaaaagctgaaaatgccccaaaatccccctggagtggtggcaagaaaatcccattgaaggcacactgggagtaagggcagtaactggtgttgaagagctccaggatgctttgatggcattgttgatagtttccaataccctggatttcaaactgctggaatggaagagtcatctcaaatctcttggtgcagggggtcttgtaaaggtcacttacgttcactaccttcttatatccaggatgaaagcatgggtccctgagaatttcattacttgcaacctgaatgtccttggccagtttctgccagagtgcctgatccttcccatagcacaagaagctatgtgtgtagacattgtagtccttgccatagaggcgaaattgcagagcattatctggggactcgatagtctggttttggggtacaaaagtgacttgtgtagaggctcccccaaggtccaaagctccaaaggtttcctgattattggtttcatatgggactatgctgaaccaccttgttttctgactgaatttgcccagcagatagttgatagtaatccagccataggcaccttcctcttggccagtaatgatcctggcaccctggaagtcaaaggggtagttgctgaggctcctctccaccacatccagaaccctgtctgccaactcttcactttccatcctgagcaaccgcatgcctgccgtggctcccaggtaaacgggtgtctcttggtgctgggaccttggaatcacttccctagctctttccatgcaatcagtcaggtaaatgcctatttcatttactttctgaacaaattttgagattccaggacctttaaccctgcattcttctacttgatgcaccacgcctgtgtcattctccttttctgctggccacttatagatgtataaacttgtgtgagaagaacccgcatccagcacaatcccatacttaacgttttctggcaatgctttgttctgggtcaaccccacagcaagcaaagctatcacagctatgatagaggagaagccaaggatggctaggatattcttggagcaaaatgtcttcacgttagactcctttgtatcttccataggtccagggttgctctcaacatctccagccaatttcaagagagcataattagtacactgtccgcttccgagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagctgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcattggctgccacccggctgcggctctgcgggtgcggggaaccccaggccggccagggccagcgcgccaaggaccaggaccccaagcataggcccaggattctcctccacgtcgccagcctgctttaacaggctaaaattggtggcgccactgccaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcttgctttgaattagcggtggttttcacaacacctaaaaaagggtttaaaagatacctttgaaccgctaagaagcccgagaattagctccgctcaaaactcaaggggacaaattccaaaaatgacttccagcgccaggctggcctgactagtctccacccaccaaatgtgaacaaactccaacgccattacatcccctccccccgccgcgactagccgtgctcaaaagcccgaggtgactattgcggccgataggaccacggggtcacaggaagcagcagccggtgagggaccaggccctcttcctttgtgtgggtgactcacccgcccgctccaccgggctgccgcgtcctccattttgagctccttgcaacagggcccgggagcggccatctttccacgcacgcaactggtgccggacgggatggcctcaccctagttagggaggcagggcaacgcggcgccgccaagccagatcgtgccgggtgctggggccacatggcctcggcacgctaaccccagcctggttgcttcgggaaaaaccccaggcctcgccccatccaggtggcgtcggacatgtgctccgaaggcgggcgggccccagccgccactcctgtccctccattcctccccaaccatgacctctccgggctccgggcgagcaagccccgcaccctccctttgttagcccctattgctgaacggcaatcgaaggcagcagggcaacaacaacaacaaaaaaaaaaagaccagagtgcggccggagtagcacgcggcggcggcgcggacaccacgctaggcctcaagccggacacgaggcgaggctacggggttgccgctaggcctcgcactctgcctcccgcgccgcccgcaactcgaagcgggaatgctcgcagctaatccccgccgacgacagcggggcccggcccgctcggagcaggacctccagctcggcggcccgcggaagccacacccgcccctcacctgcgttctgacggcaaacccgttgcgaaaaagaacgtccaaggcgactgccgcacttatataccgttctcccccaccctcgggaagagggcggagccagcacacgacaccgctttcccagtttgccccgcgccagctccccggtcctcccccccactcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaatgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcgggggaagcgtcgggccggagcggagccccgggcggctcgctgctgccccctagcgggagagggacgcaattacatccctgggggctttgggggggggctgtccccg

SEQ ID NO: 202 - DNA, 20217 bp, synthetic construct
  misc_feature 1..20217: note = 14P
  source 1..20217: mol_type = other DNA
cggggacagcccccccccaaagcccccagggatgtaattgcgtccctctcccgctagggggcagcagcgagccgcccggggctccgctccggcccgacgcttcccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccagcagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcctatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccaccatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgggaggcggaggatctggcggcggaggaagtggcggaggcggaagcggtggtggtggatctgggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagcgtttcagacaaaaagatgatgggaaatgccccttgaatcctcacagccacctaggaacatatggagtttttacaaacgctgcatttgacccgagtcctatgcttggggtcctggtccttggcgcgctggccctggccggcctggggttccccgcacccgcagagccgcagccgggtggcagccaatgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctaagctcgctttcttgctgtccaatttctattaaaggttcctttgttccccaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaagggggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagctttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattagggatgaaggctccaggctgctgccagaaatggagtcaccagcagaagaactgttttctctgataaggatgtcccaccattttcaagctgttcgttaaagttacacaggtccttcttgcagcagtagtacgttagctcattttccctcaagcgggttgtgacgtcgttgaaattgcaatgctcaaacttccaacacttgttatacacttgtaacccagctttggtaatgagacacgcatcaaaatcagatgaacaattgacggctgttttgcagtcagcagttgggttaggacagttgtagcactgcaggctatgacctgaatggcagaagacagccaggacgagcagcagcccgaacaggacagaccctccttggattcccataggcccggggttctcctccacgtcgccagcctgcttaaggagtgagaagttggtggctccactgccgagagaagtaaattttacttctctgtgggtctcatcagttaggtatgtgcctttcttcttcctcctttgaagatatctgtacgggacaacacaaattactgcaactccaacaactatggcaataacaatcacagcaatgacccaaacatccaaactgtcaagtattccttcctcaggtttaggatatcctggataatttgagactggaggcttgtaagtaggcctaggacctgaggcactggacgctggagattttgtagtggaagaagtcgacactgaatgactcaaagctggaggttttgtactagatggaggcagcactttaagacactttggaactgggggatcccaagtactgttactgtcacagacaattgtgtcgctgccatcgaggtaaaaacccttatcgcattcaaacataactgttgctttgtagtaaaatttttttccaaatcctgatatctgttttccattttcgactactggaaatcgacatttgaccactttacactctggagcagcacgactccacactgaattgtcaccacaataaatcgtgctctctccaataagtgaaaatggatctggtccaggtgcaggatcacaactataagttactgcatcaagatactcaaatacttctacttcactaaaggtgtgttttccattttttatttttggaggtggtgtacacaaaaccttttcacatattgggggcttaccgctccaaattgctactgatcctttaagttcacaatatagaatttcttcaccaattaagtaataaccctcattacaaataaagtgcatctgataaccaaactcgtaagtcccatttgcagggactgcttggccatttaaaggatcccgtatatatggacatgtttctctataacaggcgtcatctgagacaggtagccatgtatgattccgatcacaaatagtatgggtggcaagaggaggtatatagaagtatccttttttacacttataatctactcgttcaccaatctcatagtagggttttggtttaccaatgagctccatagcttcaaatgttggtggctcctcacaggcatcggagaaggagtacagcagcaacaccatggccgccagaagcaacccaggaaagcgccaggaaggaaagggacactcgcggcggccgggaggctccatggtggctcacgacacctgaaatggaagaaaaaaactttgaaccactgtctgaggcttgagaatgaaccaagatccaaactcaaaaagggcaaattccaaggagaattacatcaagtgccaagctggcctaacttcagtctccacccactcagtgtggggaaactccatcgcataaaacccctccccccaacctaaagacgacgtactccaaaagctcgagaactaatcgaggtgcctggacggcgcccggtactccgtggagtcacatgaagcgacggctgaggacggaaaggcccttttcctttgtgtgggtgactcacccgcccgctctcccgagcgccgcgtcctccattttgagctccctgcagcagggccgggaagcggccatctttccgctcacgcaactggtgccgaccgggccagccttgccgcccagggcggggcgatacacggcggcgcgaggccaggcaccagagcaggccggccagcttgagactacccccgtccgattctcggtggccgcgctcgcaggccccgcctcgccgaacatgtgcgctgggacgcacgggccccgtcgccgcccgcggccccaaaaaccgaaataccagtgtgcagatcttggcccgcatttacaagactatcttgccagaaaaaaagcgtcgcagcaggtcatcaaaaattttaaatggctagagacttatcgaaagcagcgagacaggcgcgaaggtgccaccagattcgcacgcggcggccccagcgcccaggccaggcctcaactcaagcacgaggcgaaggggctccttaagcgcaaggcctcgaactctcccacccacttccaacccgaagctcgggatcaagaatcacgtactgcagccaggtggaagtaattcaaggcacgcaagggccataacccgtaaagaggccaggcccgcgggaaccacacacggcacttacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagcctcaggcaccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctctcccacggaggcggctggccgacttccactgaggcgccaacggcctcgccatgcccttttcaataactcattgatttcaaacccgttacgtccatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggccagcgtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcggggggggggggggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgtctcgctccgtggccttagctgtgctcgcgctactctctctttctggcctcgaggctatggctccgcggactttaattttaggttgcggcgcttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataaaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacagagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttgggggggggctgtccccg

SEQ ID NO: 203 - DNA, 20217 bp, synthetic construct; identical to SEQ ID NO: 202
  misc_feature 1..20217: note = 14PV_LL
  source 1..20217: mol_type = other DNA

SEQ ID NO: 204 - DNA, 24170 bp, synthetic construct
  misc_feature 1..24170: note = 14S
  source 1..24170: mol_type = other DNA
cggggacagcccccccccaaagcccccagggatgtaattgcgtccctctcccgctagggggcagcagcgagccgcccggggctccgctccggcccgacgcttcccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccagcagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcctatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccaccatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgggaggcggaggatctggcggcggaggaagtggcggaggcggaagcggtggtggtggatctgggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagcgtttcagacaaaaagatgatgggaaatgccccttgaatcctcacagccacctaggaacatatggagtttttacaaacgctgcatttgacccgagtcctggcagtggcgccaccaattttagcctgttaaagcaggctggcgacgtggaggagaatcctgggcctatgcttggggtcctggtccttggcgcgctggccctggccggcctggggttccccgcacccgcagagccgcagccgggtggcagccaatgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctaagctcgctttcttgctgtccaatttctattaaaggttcctttgttccccaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaagggggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagctttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattagggatgaaggctccaggctgctgccagaaatggagtcaccagcagaagaactgttttctctgataaggatgtcccaccattttcaagctgttcgttaaagttacacaggtccttcttgcagcagtagtacgttagctcattttccctcaagcgggttgtgacgtcgttgaaattgcaatgctcaaacttccaacacttgttatacacttgtaacccagctttggtaatgagacacgcatcaaaatcagatgaacaattgacggctgttttgcagtcagcagttgggttaggacagttgtagcactgcaggctatgacctgaatggcagaagacagccaggacgagcagcagcccgaacaggacagaccctccttggattcccataggtccagggttggactccacgtctcccgccaacttgagaaggtcaaaattcaaagtctgtttcactccgcttccgagagaagtaaattttacttctctgtgggtctcatcagttaggtatgtgcctttcttcttcctcctttgaagatatctgtacgggacaacacaaattactgcaactccaacaactatggcaataacaatcacagcaatgacccaaacatccaaactgtcaagtattccttcctcaggtttaggatatcctggataatttgagactggaggcttgtaagtaggcctaggacctgaggcactggacgctggagattttgtagtggaagaagtcgacactgaatgactcaaagctggaggttttgtactagatggaggcagcactttaagacactttggaactgggggatcccaagtactgttactgtcacagacaattgtgtcgctgccatcgaggtaaaaacccttatcgcattcaaacataactgttgctttgtagtaaaatttttttccaaatcctgatatctgttttccattttcgactactggaaatcgacatttgaccactttacactctggagcagcacgactccacactgaattgtcaccacaataaatcgtgctctctccaataagtgaaaatggatctggtccaggtgcaggatcacaactataagttactgcatcaagatactcaaatacttctacttcactaaaggtgtgttttccattttttatttttggaggtggtgtacacaaaaccttttcacatattgggggcttaccgctccaaattgctactgatcctttaagttcacaatatagaatttcttcaccaattaagtaataaccctcattacaaataaagtgcatctgataaccaaactcgtaagtcccatttgcagggactgcttggccatttaaaggatcccgtatatatggacatgtttctctataacaggcgtcatctgagacaggtagccatgtatgattccgatcacaaatagtatgggtggcaagaggaggtatatagaagtatccttttttacacttataatctactcgttcaccaatctcatagtagggttttggtttaccaatgagctccatagcttcaaatgttggtggctcctcacaggcatcggagaaggagtacagcagcaacaccatggccgccagaagcaacccaggaaagcgccaggaaggaaagggacactcgcggcggccgggaggctccatggtggctcacgacacctgaaatggaagaaaaaaactttgaaccactgtctgaggcttgagaatgaaccaagatccaaactcaaaaagggcaaattccaaggagaattacatcaagtgccaagctggcctaacttcagtctccacccactcagtgtggggaaactccatcgcataaaacccctccccccaacctaaagacgacgtactccaaaagctcgagaactaatcgaggtgcctggacggcgcccggtactccgtggagtcacatgaagcgacggctgaggacggaaaggcccttttcctttgtgtgggtgactcacccgcccgctctcccgagcgccgcgtcctccattttgagctccctgcagcagggccgggaagcggccatctttccgctcacgcaactggtgccgaccgggccagccttgccgcccagggcggggcgatacacggcggcgcgaggccaggcaccagagcaggccggccagcttgagactacccccgtccgattctcggtggccgcgctcgcaggccccgcctcgccgaacatgtgcgctgggacgcacgggccccgtcgccgcccgcggccccaaaaaccgaaataccagtgtgcagatcttggcccgcatttacaagactatcttgccagaaaaaaagcgtcgcagcaggtcatcaaaaattttaaatggctagagacttatcgaaagcagcgagacaggcgcgaaggtgccaccagattcgcacgcggcggccccagcgcccaggccaggcctcaactcaagcacgaggcgaaggggctccttaagcgcaaggcctcgaactctcccacccacttccaacccgaagctcgggatcaagaatcacgtactgcagccaggtggaagtaattcaaggcacgcaagggccataacccgtaaagaggccaggcccgcgggaaccacacacggcacttacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagcctcaggcaccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctctcccacggaggcggctggccgacttccactgaggcgccaacggcctcgccatgcccttttcaataactcattgatttcaaacccgttacgtccatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggccagcgtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcggggggggggggggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgtctcgctccgtggccttagctgtgctcgcgctactctctctttctggcctcgaggctatggctccgcggactttaattttaggttgcggcgcttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataacccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgattatatggccacaaccatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggcggcagcggcgccaccaatttctcactactgaaacaggccggtgacgtcgaggagaaccccgggcctatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgtgaaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacagagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttgggggggggctgtccccg

SEQ ID NO: 205 - DNA, 27577 bp, synthetic construct
  misc_feature 1..27577: note = 15M1
  source 1..27577: mol_type = other DNA
cggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgaggcacacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcacccggcgctcacccgtcccagccccgccgcccgcagccccagctgcaacgcagccaccgccgccatcgcacccggccccgcgggcgcttccgggacgcaggaagcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaatgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccaccatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgggaggcggaggatctggcggcggaggaagtggcggaggcggaagcggtggtggtggatctgggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagcgtttcagacaaaaagatgatgggaaatgccccttgaatcctcacagccacctaggaacatatggagtttttacaaacgctgcatttgacccgagtcctggcagtggcgccaccaattttagcctgttaaagcaggctggcgacgtggaggagaatcctgggcctatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactcggaagcggacagtgtactaattatgctctcttgaaattggctggagatgttgagagcaaccctggacctatggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagtaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattagggatgaaggctccaggctgctgccagaaatggagtcaccagcagaagaactgttttctctgataaggatgtcccaccattttcaagctgttcgttaaagttacacaggtccttcttgcagcagtagtacgttagctcattttccctcaagcgggttgtgacgtcgttgaaattgcaatgctcaaacttccaacacttgttatacacttgtaacccagctttggtaatgagacacgcatcaaaatcagatgaacaattgacggctgttttgcagtcagcagttgggttaggacagttgtagcactgcaggctatgacctgaatggcagaagacagccaggacgagcagcagcccgaacaggacagaccctccttggattcccataggcccggggttctcctccacgtcgccagcctgcttaaggagtgagaagttggtggctccactgccagtcagcaagcccatggttactagcgtcccaagcaaacctgtcaacgtgaaacacgtgtgcccagatagaagacgggtagtacctgaagtggttccacttcctttatttggggttgtttcatgaaaatgcttggttgtcctggaaacaggtgtactccgtgttgcttgagcatttggtgtggtggtttttgtggtggttttctgagaagttggtgagacttctgtagttggaacatttactgtggtaggtttctgaactgttggtgggaccttggaagttagagattttcctctgcattcaggtggtgggccactccactctccttcatcattattcacagtacaataaatagagtgctctccaatcatggtgaatcctttattacatgcatacgttacagactgtctatatccataatggtcacgttccccttgaattattccattgtcaatttgtggtggtgctggacaataaatttctctgcactctggcaacgggtcactccactggacagagctgcctgaaataagacaaaaactagaagtcgagccaaataatttgtaccctgtgttacatgagaaggagatggttgcaccaaataatatgccacctggtacatcaatctgaccatttcgtatttctcccggattagggcatgatttctttttacaaaattcgactgctgtggaccattttaaattctgaaggcaagttagttttggtgatagagaaggttctcttctgtaacctggacggcactcatattccacaacagtaccgactggaaaataattctgagtgatataaggctgtttgagggatgcagaatttagccttgttggcacctcgcagctacgattgcagaactcttcaatatctgaccattgactgcccttaaggcagatcactgagtccttctcgccaggaattttcacaaagctttcttcacatttgtacgttattacagtatcctcgggaaaacttgtacggccttccaaagctggctgggcattaggtacatctgggggaaggccacagtcaccccacacggccggcaggcacaacagcaccagcagcagcagccggggcagctccccgaggaggggcagcgccgcgggcacgctcggccgcgcgacggtcataggtccagggttggactccacgtctcccgccaacttgagaaggtcaaaattcaaagtctgtttcactccgcttccgagagaagtaaattttacttctctgtgggtctcatcagttaggtatgtgcctttcttcttcctcctttgaagatatcggtacgggacaacacaaattactgcaactccaacaactatggcaataacaatcacagcaatgacccaaacatccaaactgtcaagtattccttcctcaggtttaggatatcctggataatttgagactggaggcttgtaagtaggcctaggacctgaggcactggacgctggagattttgtagtggaagaagtcgacactgaatgactcaaagctggaggttttgtactagatggaggcagcactttaagacactttggaactgggggatcccaagtactgttactgtcacagacaattgtgtcgctgccatcgaggtaaaaacccttatcgcattcaaacataactgttgctttgtagtaaaatttttttccaaatcctgatatctgttttccattttcgactactggaaatcgacatttgaccactttacactctggagcagcacgactccacactgaattgtcaccacaataaatcgtgctctctccaataagtgaaaatggatctggtccaggtgcaggatcacaactataagttactgcatcaagatactcaaatacttctacttcactaaaggtgtgttttccattcttgatctttggaggtggtgtacacaagaccttctcacatattgggggcttaccgctccaaattgctactgatcctttaagttcacaatacaggatctcctcaccaatcaggtagtaaccctcgttgcagatgaagtgcatctgataaccaaactcgtaagtcccatttgcagggactgcttggccatttaaaggatcccgtatatatggacatgtttctctataacaggcgtcatctgagacaggtagccatgtatgattccgatcacaaatagtatgggtggcaagaggaggtatatagaagtatccttttttacacttataatctactcgttcaccaatctcatagtagggttttggtttgccgatgagctccatagcttcaaatgttggtggctcctcacaggcatcggagaaggagtacagcagcaacaccatggccgccagaagcaacccaggaaagcgccaggaaggaaagggacactcgcggcggccgggaggctccatggtggcttagcttttagcgatggctttcacgacacctaagacgacaaaaaccttctttaaactactgtcccgacgaccggagactcaggcacaaccccaacagccaagggcaaactccagggagcattagcaccggcgccctgcgggccctgcccggcctacacccagcgaacggggccgccccggcgcccagcccctcccccacccgggccgcgagtcccgggaagcggcgcgggcagcaccgcccggccctttgtgcgccgcccgccgtccgcgtcctccatcttgagaccgggagcggccatctttccgcgctcgcagcccgcccgggcggggcgctgggtctccgaccgcccgccccgccccgccgcggccgtctgccccgggaccgccgggcacggaggccaccttgggcggcctcggctgggccgccctggcagtaacacgcggctgccggccgaactcgagcgcgaagacagacggggcgggcgcgaaggcgcggatcgcacgcggcggccacggcgccccagcaggccgccaccgggcacgcggtagggaaccgcgagagcggagggcctcgagttctccacctccccccgcccgcagctcggaatcaggaccagggcgcagagccctctacgcgcggggggccgggaggcacgctaaggccgtggccaccggcggaggccatgcggacggaggccacacccgtactcacctgtgtcctggcggcaaacccgttgcgaaaaagaacgttcgcggggaccacggcgcttatatatggtcctcccccaccctcggggaaaagggcggagccagcacacgacaccactttcccagtttaccccgcgccacctccacccggcaccggttccaccgccgtcccctccccccatcttcggggaccgtgggcgatgtgcgttcagcccactgacgagcacacggcgcccgggggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgtctcgctccgtggccttagctgtgctcgcgctactctctctttctggcctcgaggctgttatggctccgcggactttaattttaggttgcggcgcttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataacccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgattatatggccacaaccatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggcggcagcggcgccaccaatttctcactactgaaacaggccggtgacgtcgaggagaaccccgggcctatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgggaagcggagagggcagaggaagtctgctaacatgcggtgacgtcgaggagaatcctggacctatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaaaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacggagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccg

SEQ ID NO: 206 - DNA, 27929 bp, synthetic construct
  misc_feature 1..27929: note = 15M2
  source 1..27929: mol_type = other DNA
cggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgggaggcggaggatctggcggcggaggaagtggcggaggcggaagcggtggtggtggatctgggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagcgtttcagacaaaaagatgatgggaaatgccccttgaatcctcacagccacctaggaacatatggagtttttacaaacgctgcatttgacccgagtcctggcagtggcgccaccaattttagcctgttaaagcaggctggcgacgtggaggagaatcctgggcctatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactcggaagcggacagtgtactaattatgctctcttgaaattggctggagatgttgagagcaaccctggacctatggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagtaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattagggatgaaggctccaggctgctgccagaaatggagtcaccagcagaagaactgttttctctgataaggatgtcccaccattttcaagctgttcgttaaagttacacaggtccttcttgcagcagtagtacgttagctcattttccctcaagcgggttgtgacgtcgttgaaattgcaatgctcaaacttccaacacttgttatacacttgtaacccagctttggtaatgagacacgcatcaaaatcagatgaacaattgacggctgttttgcagtcagcagttgggttaggacagttgtagcactgcaggctatgacctgaatggcagaagacagccaggacgagcagcagcccgaacaggacagaccctccttggattcccataggcccggggttctcctccacgtcgccagcctgcttaaggagtgagaagttggtggctccactgccagtcagcaagcccatggttactagcgtcccaagcaaacctgtcaacgtgaaacacgtgtgcccagatagaagacgggtagtacctgaagtggttccacttcctttatttggggttgtttcatgaaaatgcttggttgtcctggaaacaggtgtactccgtgttgcttgagcatttggtgtggtggtttttgtggtggttttctgagaagttggtgagacttctgtagttggaacatttactgtggtaggtttctgaactgttggtgggaccttggaagttagagattttcctctgcattcaggtggtgggccactccactctccttcatcattattcacagtacaataaatagagtgctctccaatcatggtgaatcctttattacatgcatacgttacagactgtctatatccataatggtcacgttccccttgaattattccattgtcaatttgtggtggtgctggacaataaatttctctgcactctggcaacgggtcactccactggacagagctgcctgaaataagacaaaaactagaagtcgagccaaataatttgtaccctgtgttacatgagaaggagatggttgcaccaaataatatgccacctggtacatcaatctgaccatttcgtatttctcccggattagggcatgatttctttttacaaaattcgactgctgtggaccattttaaattctgaaggcaagttagttttggtgatagagaaggttctcttctgtaacctggacggcactcatattccacaacagtaccgactggaaaataattctgagtgatataaggctgtttgagggatgcagaatttagccttgttggcacctcgcagctacgattgcagaactcttcaatatctgaccattgactgcccttaaggcagatcactgagtccttctcgccaggaattttcacaaagctttcttcacatttgtacgttattacagtatcctcgggaaaacttgtacggccttccaaagctggctgggcattaggtacatctgggggaaggccacagtcaccccacacggccggcaggcacaacagcaccagcagcagcagccggggcagctccccgaggaggggcagcgccgcgggcacgctcggccgcgcgacggtcataggtccagggttggactccacgtctcccgccaacttgagaaggtcaaaattcaaagtctgtttcactccgcttccgagagaagtaaattttacttctctgtgggtctcatcagttaggtatgtgcctttcttcttcctcctttgaagatatcggtacgggacaacacaaattactgcaactccaacaactatggcaataacaatcacagcaatgacccaaacatccaaactgtcaagtattccttcctcaggtttaggatatcctggataatttgagactggaggcttgtaagtaggcctaggacctgaggcactggacgctggagattttgtagtggaagaagtcgacactgaatgactcaaagctggaggttttgtactagatggaggcagcactttaagacactttggaactgggggatcccaagtactgttactgtcacagacaattgtgtcgctgccatcgaggtaaaaacccttatcgcattcaaacataactgttgctttgtagtaaaatttttttccaaatcctgatatctgttttccattttcgactactggaaatcgacatttgaccactttacactctggagcagcacgactccacactgaattgtcaccacaataaatcgtgctctctccaataagtgaaaatggatctggtccaggtgcaggatcacaactataagttactgcatcaagatactcaaatacttctacttcactaaaggtgtgttttccattcttgatctttggaggtggtgtacacaagaccttctcacatattgggggcttaccgctccaaattgctactgatcctttaagttcacaatacaggatctcctcaccaatcaggtagtaaccctcgttgcagatgaagtgcatctgataaccaaactcgtaagtcccatttgcagggactgcttggccatttaaaggatcccgtatatatggacatgtttctctataacaggcgtcatctgagacaggtagccatgtatgattccgatcacaaatagtatgggtggcaagaggaggtatatagaagtatccttttttacacttataatctactcgttcaccaatctcatagtagggttttggtttgccgatgagctccatagcttcaaatgttggtggctcctcacaggcatcggagaaggagtacagcagcaacaccatggccgccagaagcaacccaggaaagcgccaggaaggaaagggacactcgcggcggccgggaggctccatggtggcttagcttttagcgatggctttcacgacacctaagacgacaaaaaccttctttaaactactgtcccgacgaccggagactcaggcacaaccccaacagccaagggcaaactccagggagcattagcaccggcgccctgcgggccctgcccggcctacacccagcgaacggggccgccccggcgcccagcccctcccccacccgggccgcgagtcccgggaagcggcgcgggcagcaccgcccggccctttgtgcgccgcccgccgtccgcgtcctccatcttgagaccgggagcggccatctttccgcgctcgcagcccgcccgggcggggcgctgggtctccgaccgcccgccccgccccgccgcggccgtctgccccgggaccgccgggcacggaggccaccttgggcggcctcggctgggccgccctggcagtaacacgcggctgccggccgaactcgagcgcgaagacagacggggcgggcgcgaaggcgcggatcgcacgcggcggccacggcgccccagcaggccgccaccgggcacgcggtagggaaccgcgagagcggagggcctcgagttctccacctccccccgcccgcagctcggaatcaggaccagggcgcagagccctctacgcgcggggggccgggaggcacgctaaggccgtggccaccggcggaggccatgcggacggaggccacacccgtactcacctgtgtcctggcggcaaacccgttgcgaaaaagaacgttcgcggggaccacggcgcttatatatggtcctcccccaccctcggggaaaagggcggagccagcacacgacaccactttcccagtttaccccgcgccacctccacccggcaccggttccaccgccgtcccctccccccatcttcggggaccgtgggcgatgtgcgttcagcccactgacgagcacacggcgcccgggggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgtctcgctccgtggccttagctgtgctcgcgctactctctctttctggcctcgaggctgttatggctccgcggactttaattttaggttgcggcgcttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataacccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgattatatggccacaaccatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggcggcagcggcgccaccaatttctcactactgaaacaggccggtgacgtcgaggagaaccccgggcctatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgggaagcggagagggcagaggaagtctgctaacatgcggtgacgtcgaggagaatcctggacctatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaaaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacggagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccg

SEQ ID NO: 207 - DNA, 21292 bp, synthetic construct
  misc_feature 1..21292: note = 15P
  source 1..21292: mol_type = other DNA
cggggacagcccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccagcagcccagactgcccagagccacatccagcctggccttgaatgcctgcagggatggggcatccacagcctccttgggcaacctgttcagtgcgtcaccaccctctggggggaaaacttcctcctcatatccaacctaaacctcccctgtctcagtttaaagccattccctcctgtcctatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgaggcacacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcaccccgcacccggcgctcacccgtcccagccccgccgcccgcagccccagctgcaacgcagccaccgccgccatcgcacccggccccgcgggcgcttccgggacgcaggaagcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaagggggcgcggcaggagggggcaccagggagcggagccctggccctcctgacgtcctgcccgcccacgcgtccgcaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgtaggtggtctgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccaccatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgggaggcggaggatctggcggcggaggaagtggcggaggcggaagcggtggtggtggatctgggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagcgtttcagacaaaaagatgatgggaaatgccccttgaatcctcacagccacctaggaacatatggagtttttacaaacgctgcatttgacccgagtcctggcagtggcgccaccaattttagcctgttaaagcaggctggcgacgtggaggagaatcctgggcctatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctaagctcgctttcttgctgtccaatttctattaaaggttcctttgttccccaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaagggggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagctttttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattagggatgaaggctccaggctgctgccagaaatggagtcaccagcagaagaactgttttctctgataaggatgtcccaccattttcaagctgttcgttaaagttacacaggtccttcttgcagcagtagtacgttagctcattttccctcaagcgggttgtgacgtcgttgaaattgcaatgctcaaacttccaacacttgttatacacttgtaacccagctttggtaatgagacacgcatcaaaatcagatgaacaattgacggctgttttgcagtcagcagttgggttaggacagttgtagcactgcaggctatgacctgaatggcagaagacagccaggacgagcagcagcccgaacaggacagaccctccttggattcccataggtccagggttggactccacgtctcccgccaacttgagaaggtcaaaattcaaagtctgtttcactccgcttccgagagaagtaaattttacttctctgtgggtctcatcagttaggtatgtgcctttcttcttcctcctttgaagatatctgtacgggacaacacaaattactgcaactccaacaactatggcaataacaatcacagcaatgacccaaacatccaaactgtcaagtattccttcctcaggtttaggatatcctggataatttgagactggaggcttgtaagtaggcctaggacctgaggcactggacgctggagattttgtagtggaagaagtcgacactgaatgactcaaagctggaggttttgtactagatggaggcagcactttaagacactttggaactgggggatcccaagtactgttactgtcacagacaattgtgtcgctgccatcgaggtaaaaacccttatcgcattcaaacataactgttgctttgtagtaaaatttttttccaaatcctgatatctgttttccattttcgactactggaaatcgacatttgaccactttacactctggagcagcacgactccacactgaattgtcaccacaataaatcgtgctctctccaataagtgaaaatggatctggtccaggtgcaggatcacaactataagttactgcatcaagatactcaaatacttctacttcactaaaggtgtgttttccattcttgatctttggaggtggtgtacacaagaccttctcacatattgggggcttaccgctccaaattgctactgatcctttaagttcacaatacaggatctcctcaccaatcaggtagtaaccctcgttgcagatgaagtgcatctgataaccaaactcgtaagtcccatttgcagggactgcttggccatttaaaggatcccgtatatatggacatgtttctctataacaggcgtcatctgagacaggtagccatgtatgattccgatcacaaatagtatgggtggcaagaggaggtatatagaagtatccttttttacacttataatctactcgttcaccaatctcatagtagggttttggtttaccaatgagctccatagcttcaaatgttggtggctcctcacaggcatcggagaaggagtacagcagcaacaccatggccgccagaagcaacccaggaaagcgccaggaaggaaagggacactcgcggcggccgggaggctccatggtggctcacgacacctgaaatggaagaaaaaaactttgaaccactgtctgaggcttgagaatgaaccaagatccaaactcaaaaagggcaaattccaaggagaattacatcaagtgccaagctggcctaacttcagtctccacccactcagtgtggggaaactccatcgcataaaacccctccccccaacctaaagacgacgtactccaaaagctcgagaactaatcgaggtgcctggacggcgcccggtactccgtggagtcacatgaagcgacggctgaggacggaaaggcccttttcctttgtgtgggtgactcacccgcccgctctcccgagcgccgcgtcctccattttgagctccctgcagcagggccgggaagcggccatctttccgctcacgcaactggtgccgaccgggccagccttgccgcccagggcggggcgatacacggcggcgcgaggccaggcaccagagcaggccggccagcttgagactacccccgtccgattctcggtggccgcgctcgcaggccccgcctcgccgaacatgtgcgctgggacgcacgggccccgtcgccgcccgcggccccaaaaaccgaaataccagtgtgcagatcttggcccgcatttacaagactatcttgccagaaaaaaagcgtcgcagcaggtcatcaaaaattttaaatggctagagacttatcgaaagcagcgagacaggcgcgaaggtgccaccagattcgcacgcggcggccccagcgcccaggccaggcctcaactcaagcacgaggcgaaggggctccttaagcgcaaggcctcgaactctcccacccacttccaacccgaagctcgggatcaagaatcacgtactgcagccaggtggaagtaattcaaggcacgcaagggccataacccgtaaagaggccaggcccgcgggaaccacacacggcacttacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagcctcaggcaccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctctcccacggaggcggctggccgacttccactgaggcgccaacggcctcgccatgcccttttcaataactcattgatttcaaacccgttacgtccatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggccagcgtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgtctcgctccgtggccttagctgtgctcgcgctactctctctttctggcctcgaggctgttatggctccgcggactttaattttaggttgcggcgcttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataaaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacagagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaatgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccg

SEQ ID NO: 208 - DNA, 21702 bp, synthetic construct
  misc_feature 1..21702: note = 15S
  source 1..21702: mol_type = other DNA
cggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgtggaagcggagctactaacttcagcctgctgaagcaggctggagacgtggaggagaaccctggacctatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactatcacatggcataaagccctacagcaactgtcgccaccagaaagctgagtgtaaggacccatcggagaagcggagcctgggagcgggtgttgagtgggggcttccctctgggagtctccacgggggcagaatcttgcactttgttgctggcccgctggcgaagccctggtgcccgtgaggggctctggtccttggtgtcatgggtcagcagctcctgcaactcctcaaagagctggatgttgagcaggaacgcagtcttggcctcttctatcaccctctgcctgactgcgggagtcatctccagggagttcatgcgggagcggtagagctgcttgaacttggtggcactggcaatgttggggaaggtgaagaaggccaggccctcgccagagctgggcaggtccagggctttctgggcaatctttttgagcacctggcccccagacaggtcacccaggtagcgggtgtaggcgtgggccaccagcagctcgggctctgtgcgccccacctcgtggagccgcttcacatagcgctgcatggctggtgtgtaggggatgacctcctgccagcggggcccgtaccagaaggccaggtcctgctccagggcagccttgcggtgcagctcttctgggaagtagacaggggcgaagactgggctctccttgttgcgctcaatctcctcctccagggccacatagatgtggtacagggaggccatcaccagcttgaagccgtctcgggtcacctggcccttctgaaagttcctcatgaactcagcattctctgcctgggtgtgcacctccttggtggcctccttcagggcctctgacaaatcctggggcatgctgtcgggttgcggacgctccataggtccagggttgctctcaacatctccagccaatttcaagagagcataattagtacactgtccgcttccgccatacatctgcttgaactgaaagcattcgttgcagtagccgttgcacttggcattgccaaaatgatcacaggcgggggcccggcaacgctgcttgggggggtcttcgggggcaggctcaccccggtgggccccagggcccatcctctggttgggatgctgacactccatgcagagctcctcgctgcggcaggccaggatgttcttgcaggaggcccgggcgcacttgggccttgaggtgctttgtgtggttcgaggcacatctctgcgctggctcgatctcagttgctcttctgtccttttggcctcatgaaatctctgattctgagcttcaatgaaacacttctggcagtatccttcaaacatggtgcttccaagggtgccgcattccctccccaggcacggaatggtgttctggaacctggacgctgtgggactgactttccctgaggcagcagcaaaatgtttgttttctctgtactcgatgaaacacagtgtgcaaaagcccttgttttctggagtcccaaaatacacgcagccggcttttctgcacttgctcgtccccgtcctgtccccaggagtccgtgcagcttgagacaggcagccagcaggggcgtcgtttccagctctgtggcaagaatgcggggaggggctccggacgagccgcgagggatctgacttggaacgctggtgacaggaaggagggaggctggtgctgaggctggaggaggcctctgctgtagtccttttgaagcaagtactgcagatcccattaaatgtcctggtaacatcctggaggcaggcttggcacttcccgggatccaagtgccttgtgtggtctggggcgtggctggcgtgaagttgccgggcgttgtggcaacgttcacaaaatccgttgtgctgcacattcagtgtgaaggggcagccggggctcctgcacttcatggcagtggtctcactgaacagaaaagggctgggtgctgtcggtggggccgaatgaggccccccagtggactcctcagggttccacgccaagggctcataggcttctccccgagaggccccgagcgccatgccagggagcccctcagggcccggcttggagttcagctttgggagtttgttttgattcttttgccgcctctctgagcactcatggcataaaggctgggtgttcacagacatgaagaaggggcagttgggcgtttcacattttacatccatgagagaaagctggggcacggaaggttccatgggattctgggcgtgcccctctctcctcccctgctcgctgttttcctgccatttcttgtactcatgctgaacaagttcaaagtaatcatctaccagattgatttcttttggtaagttagcttcatccaactttgcggcattgatgagatgagttgtgccatggtcccagccttggacggggatttctatcaccattaagtactcttttaagagcttctccttcatctcattttcaggatctgtcaaaaagtgaacttttaagtcttcaaatcttccccggtctctgttaacaagtggaacagctcggatttcaggcccactgtccttcagggtcaccaagggtacaaaatgatggctgtcatagccgagaacaatggggtatctgtagcattcctgggcaggccagtggagaggcaagtaaattccacccactttcaaaggggcgaaattggaacctgattccaaacttcttagcattttgtctgaaatgacaatgattggccttctgaggatgttgcaaaggacaaatatgtgtatttcttccagtgagttgtactgaagtccacttcgggccatgggtgtgtctgtggaagccattttgataagattgtcccattcatcattccagttccgagtatcatagcaaagccccgtttcaacaaattcctgagatttgagagactccagttgccagcggaatttaaagttgcgtgtgtctgtttccttgagcgtgctgaacagcgccttcctcagtaccaagtctgtgtcctgaacgccccacatgtactgagaagtggcatgcatgaggcaattgccgtcaccgttcgttttcagcgccacaagcttccggacttctcgacaccagttgagtttcttctggctttccagggtggcctggatgtttctgtcgatgagggctttgtggatgatctcccgaaactgaggacaaaactggcaagttctgaacatttccagtgtgtatcggtgcatggttttaaaatgatgaatgatcccattagtaggtttaaaaatgtcttctggagttctctcccgtatcttcacagctttccgcatattgctcaaatacaaagcctgaggaaggacttgttcagccatggtggcttagcttttagcgatggctttcacgacacctaagacgacaaaaaccttctttaaactactgtcccgacgaccggagactcaggcacaaccccaacagccaagggcaaactccagggagcattagcaccggcgccctgcgggccctgcccggcctacacccagcgaacggggccgccccggcgcccagcccctcccccacccgggccgcgagtcccgggaagcggcgcgggcagcaccgcccggccctttgtgcgccgcccgccgtccgcgtcctccatcttgagaccgggagcggccatctttccgcgctcgcagcccgcccgggcggggcgctgggtctccgaccgcccgccccgccccgccgcggccgtctgccccgggaccgccgggcacggaggccaccttgggcggcctcggctgggccgccctggcagtaacacgcggctgccggccgaactcgagcgcgaagacagacggggcgggcgcgaaggcgcggatcgcacgcggcggccacggcgccccagcaggccgccaccgggcacgcggtagggaaccgcgagagcggagggcctcgagttctccacctccccccgcccgcagctcggaatcaggaccagggcgcagagccctctacgcgcggggggccgggaggcacgctaaggccgtggccaccggcggaggccatgcggacggaggccacacccgtactcacctgtgtcctggcggcaaacccgttgcgaaaaagaacgttcgcggggaccacggcgcttatatatggtcctcccccaccctcggggaaaagggcggagccagcacacgacaccactttcccagtttaccccgcgccacctccacccggcaccggttccaccgccgtcccctccccccatcttcggggaccgtgggcgatgtgcgttcagcccactgacgagcacacggcgcccgggggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcacttcatctgcaacgagggttactacctgattggtgaggagatcctgtattgtgaacttaaaggatcagtagcaatttggagcggtaagcccccaatatgtgagaaggtcttgtgtacaccacctccaaagatcaagaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgactggaagcggagagggcagaggaagtctgctaacatgcggtgacgtcgaggagaatcctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataataaaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacggagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccg

SEQ ID NO: 209 - DNA, 25075 bp, synthetic construct
  misc_feature 1..25075: note = 15S1
  source 1..25075: mol_type = other DNA
ggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatcggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgggaggcggaggatctggcggcggaggaagtggcggaggcggaagcggtggtggtggatctgggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagcgtttcagacaaaaagatgatgggaaatgccccttgaatcctcacagccacctaggaacatatggagtttttacaaacgctgcatttgacccgagtcctggaagcggacagtgtactaattatgctctcttgaaattggctggagatgttgagagcaaccctggacctatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgtggaagcggagagggcagaggaagtctgctaacatgcggtgacgtcgaggagaatcctggacctatgcttggggtcctggtccttggcgcgctggccctggccggcctgggattccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcaactgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactatcagttattcctaggaggttgtatagtcttctgattggaagccacaaatttcatataaactagtccaagtaattgtgctagagctaagatactcaaacctgaaatcagaagagggccatgcattggtatacacgccgcaatacagagactcagtccaaccacagcgaggatataggctatcacctgaataaccaatatggcaatgacgaaggaggttaatccaatcgctgtactaaacacatagtagtgaagtaatattaatatccctgtagaagtcacaattaaaccaaggccagtagcattctttaatgaatattcacctgggacgaaaagaatggctccaacaatgacaatgacagtgatcactagtccagcaacaagtaaagcaattgttttctcatccataccaccggatctatatttaagtgttttaataccaaactgtccccagaacaggagtatagcaaaaattgggaaaataacaataagaatattttcatttggagaaaaccatgaaacaacacgatattttagctcgatgatcgtttcaccttctctggttaattctgttacttcacaagtgtagtttcctgtgtgtgagacagcatcactcttatccatcttcaaagaggcatctccttttagtaattgtgagacttcaatttttgcactactaaagtcagtggggacagtggacttgtttagagctccatcaaaggtgtaaatatctcttcctttaaatttccactttacgtatacttcagtagtgttttgtgcctccatattagtaacaaagcatggaatgacgacagtgtcattacaaaacgtgaattctacagattttgttttattaaatagtagctgagctgatccgcagcacgccgagcccagcaacagcgccgctaccaggggccacataggtccagggttctcctccacgtctccagcctgcttcagcaggctgaagttagtagctccgcttcccaagctgtgagactcagacccctgggcactgtcgctccactcagccttagagtagctccctccttttccacctgagctcttcttcctccatatcacagcagcaaccacagctccagagaccacagatccaaggagaaccaggccagcaatgatgcccacgatggggatggtgggctgggaagccggcttccatctcagggtgacgggctcgggtagcccctcatgctgcacatggcacgtgtatctctgctcctctccagaaggcaccaccacagctgcccacttctggaaggttccatcccctgcaggcctggtctccacgagctccgtgtcctgggtatggccctccccatcctgctgccaggtcagtgtgatctccgcagggtagaagcccagggcccagcacctcagggtggcctcatggtcagagatggggtggtgagtcacgtgtgtctttgggggctccaggtgaagcagcgtctccttccccttctccaggtatttgtggagccactccacgcatgtgtcttccaggtaggctctctggtgctccgcctcagaggcatcatttgacttttgctcggagatctgagccgccgtgtccaccgcggtccaggagcgcaggtcctcattcagggtgagataatccttgccgtcgtaggcgaactgttcatacccgcggaggaagcgcccgtcgggccccagctcgcagccatgcatccactgcagggtgtgagacccggcctcgctctgattgtagcagccgcgcagcgtccgcagattcactcggaaaatctgtgcggtgtccctggcgctccgtgtctcccggtcccaatactctgacccctcctgctccatccacggcgcccgcggcaccatcctcggactcgcggcgtcgttgtcgaagcgcacgaactgggtgtcgtccacgtagcccacagagatgaagcggggctccccgcggccgggccgggacacggaagtgtggaaatacttcaaggagtgagatccggaaccgccaccaccgcttcctccgccgccactaccgccaccaccagaaccgccaccacccatgtcgcgatcccacttaactatcttgggctgtgacaaagtcacatggttcacacggcaggcatactcatctttttcagtgggggtgaattcagtgtagtacaagagatagaaagaccagtccttgctgaaagacaagtctgaatgctccactttttcaattctctctccattcttcagtaagtcaacttcaatgtcggatggatgaaacccagacacatagcaattcaggaaatttgactttccattctctgctggatgacgtgagtaaacctgaatctttggcgtacgctggatggagccgccaccaccagaaccgccaccaccggaaccgccgcaacccaggaagagggttcggggcgccatgacagcctcgaggccagaaagagagagtagcgcgagcacagctaaggccacggagcgagacatggtggcggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatggggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagtaactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgactcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccgcggcatccctgcaagggatcctcacccccttttcttccttcattctctgctggtgtcaatcacagcttctagcagagggaaggcaggccaggcttggtttcttcttgcgagagtatttaactcagggccctgtagaacaatgagaatctgacctgcaactagctgggcgtgctggggcatgcctgtgtagtttcagctacttgggaggctgaggcaggagaattgcttgagcccaaagttgaggctgcagtgagccatggttgtgccattacactccagcctgggcaacacaagacccctgctcagaaataaaaagagaacctggcctgcagtgccaggcaggccctgaggtccaggagcctgggtatctccctctgcagcatgggtcacgaacaaactgggccctcagaggccacgggatggcgcccagtctccagtcacaaggcagaatccagacctcagcccatagctaaccagagctgtctgcaggccagatatggccccatggaccccctaccccaacttgactttgattccaggtccccctccgtctggatgaacaggtaggaattgcggcctctcctaagcctatgggagcctgggccaggctgaccctcaaggctgacagccacgatcccataggtgaaggcaaaggcgtggcagctaggaacacccactacacccccactcaagggaacaccgtgcccagctaccctgagacagccccactcccaggaaatgcaggtgccaaccagccccagtgaggcatggcacctgagccagacacccccaaatagtcccttcccacctcctcaagcatctgcactctgggtgaacccagaaaaactggggtacctggggagacatagaagggccaggccaggaactccccaataagcaggaacaggaacctgacccctgagcctcccccaccctctaaggctgctcaatgtcaaggcaggagggatctccacacacctgcactctgggtaaggacaagttggcccccactgccccacccttttgcagggttcaccctcctgcagggttcaccctctgctgcccccaacccagccacaccacaaagtcacacttggcctcaagagaaatgttctggcacctgcacttgcactggggacagcctattttgctagtttgttttgtttcgttttgttttgatggagagcgtatgttagtactatcgattcacacaaaaaaccaacacacagatgtaatgaaaataaagatattttatt

SEQ ID NO: 210 - DNA, 24780 bp, synthetic construct
  misc_feature 1..24780: note = 15S2
  source 1..24780: mol_type = other DNA
ggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatcggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactatcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcataggtccaggattctcctcgacgtcaccgcatgttagcagacttcctctgccctctccgcttccacatcgccgtccacctgtgcacaggaagatgcctacagccacaccagcaatgatgaaactgcccaccaggacgcccaggaccagcgaagtgtaggagcggcttgtttggctccctttcgtgttttccgcggaaatatgtttctgcacatactgcacacaggtgtcctccaggaattcccgcagttcataccgagtgcggttgtaggcattgagctgctgcagggtgaaggtgaccactccggaggtgacctgggtgtctgcctgccacaaggctctctccggccggaaactcacaaaggagctcccattcacagccacttcgaagaagacatgggctctagagccctcgggaggcagctcacagcccaggaagcagcggatggtcagaggaaaggccaaggtccgctcctggtgcaccaggcgcacgaggccgtggaactggagcaggtaggactgcaggccactctgcgtgcgcgcccagctctcgggctcctgcaagggctgcagctgaatgatcgtggtgttggtgtctgggccttccagcacgtgcgttaggtgtccccccagcgacgcgttgccctggtaccacacgtgataggggtcgcggaagtaggagatctggagcatatgaagtctttggaggccatctgaggcgtcttggctacaaaaggcccagccagacagcagcagtatcggcagcaatgttgtcaacataggtccagggttgctctcaacatctccagccaatttcaagagagcataattagtacactgtccgcttccaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcggttgctgaaaaaaagaaaaatctggtttaaaaattcaattaatcaaaatatttccctcatcccttaacagaacacttaaccaggaaaaacgtatggccactgccaagaggtaatagtgcccatcacctcctgtctaagcacgcgcgaggtccagaactagtgctgcagtccaggttgccgtgccaaccgcagcagagcacgccctagatgaaggacccatctacccagacggcgtggggcgttgctcaacacgtggtcttaccccgaactgagcactgtctgttcccctccctcgccaggtgccagtgcccccgggagtcaacgggcttttaactactccggaatgtacccccatactggaagcacgccaagaacagctctgaagaaccacggtgggactggactaagcagggaactgggtgaaagaaaacgctggctccacttccccgcgcgccaggcaaaccgatgcagcaaccctcccccgccacgcggccgccgggcgtctcccagcctcccctggggccactgcggcccactccctacatttccgtcctgccggctgcaaccaaataccgctgccatcccaccgaaaactgaggccctttaagccggtagaaggagccgcacactcgcctcgacgagattctcagaacccccaagcctcagcaagcccaacaggcctgtgtggaggctgcacgctcccagacccacaacccaactcttgagcagaggttttacctggggtgtaggcctggctccaataacgaaggaagccacaaaaaacccaagagctgcaggcgagttcaatgagaccggtttccgcccgccaccctgcctcttataccctatcttagaaccttccagaaggggcccgcccctgctgcctgccattacggcttccccggccaatagacgcccggctgcccttacaagacccaatcacaagcccggctccactcctcgggcctcgcccccttccgcacccaccccaccgcgctccgcctcacgataacgcactcaccgcagcgttctggaactttcaagctcgcccccgctctccggacggccccggggaaagggagggtggggcgcagcgagtccgcgcgcgggagtcctcagttaccccgggcgggggaggggagcgtccacctctacgcatgcgcccccagcttccgcgggagggagggggcggaaaaaggaggaggaagaggggcgggcaaacttggaactaaccaatgatagcggcgctagccgggatcttggccggcacagaactgggggcggaatcgcgcggggcctgaagggaggggtttgggcgcgggagccgggccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctcccccacggaggcggctggccgacttccactgaggcgccaacggcctcgccatgcccttttcaataactcattgatttcaaacccgttacgtctatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagtagtaactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgactcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccgcggcatccctgcaagggatcctcacccccttttcttccttcattctctgctggtgtcaatcacagcttctagcagagggaaggcaggccaggcttggtttcttcttgcgagagtatttaactcagggccctgtagaacaatgagaatctgacctgcaactagctgggcgtgctggggcatgcctgtgtagtttcagctacttgggaggctgaggcaggagaattgcttgagcccaaagttgaggctgcagtgagccatggttgtgccattacactccagcctgggcaacacaagacccctgctcagaaataaaaagagaacctggcctgcagtgccaggcaggccctgaggtccaggagcctgggtatctccctctgcagcatgggtcacgaacaaactgggccctcagaggccacgggatggcgcccagtctccagtcacaaggcagaatccagacctcagcccatagctaaccagagctgtctgcaggccagatatggccccatggaccccctaccccaacttgactttgattccaggtccccctccgtctggatgaacaggtaggaattgcggcctctcctaagcctatgggagcctgggccaggctgaccctcaaggctgacagccacgatcccataggtgaaggcaaaggcgtggcagctaggaacacccactacacccccactcaagggaacaccgtgcccagctaccctgagacagccccactcccaggaaatgcaggtgccaaccagccccagtgaggcatggcacctgagccagacacccccaaatagtcccttcccacctcctcaagcatctgcactctgggtgaacccagaaaaactggggtacctggggagacatagaagggccaggccaggaactccccaataagcaggaacaggaacctgacccctgagcctcccccaccctctaaggctgctcaatgtcaaggcaggagggatctccacacacctgcactctgggtaaggacaagttggcccccactgccccacccttttgcagggttcaccctcctgcagggttcaccctctgctgcccccaacccagccacaccacaaagtcacacttggcctcaagagaaatgttctggcacctgcacttgcactggggacagcctattttgctagtttgttttgtttcgttttgttttgatggagagcgtatgttagtactatcgattcacacaaaaaaccaacacacagatgtaatgaaaataaagatattttatt

SEQ ID NO: 211 - DNA, 23899 bp, synthetic construct
  misc_feature 1..23899: note = 15S3
  source 1..23899: mol_type = other DNA
ggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatcggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaacccggctcccgcgcccaaacccctcccttcaggccccgcgcgattccgcccccagttctgtgccggccaagatcccggctagcgccgctatcattggttagttccaagtttgcccgcccctcttcctcctcctttttccgccccctccctcccgcggaagctgggggcgcatgcgtagaggtggacgctcccctcccccgcccggggtaactgaggactcccgcgcgcggactcgctgcgccccaccctccctttccccggggccgtccggagagcgggggcgagcttgaaagttccagaacgctgcggtgagtgcgttatcgtgaggcggagcgcggtggggtgggtgcggaagggggcgaggcccgaggagtggagccgggcttgtgattgggtcttgtaagggcagccgggcgtctattggccggggaagccgtaatggcaggcagcaggggcgggccccttctggaaggttctaagatagggtataagaggcagggtggcgggcggaaaccggtctcattgaactcgcctgcagctcttgggttttttgtggcttccttcgttattggagccaggcctacaccccaggtaaaacctctgctcaagagttgggttgtgggtctgggagcgtgcagcctccacacaggcctgttgggcttgctgaggcttgggggttctgagaatctcgtcgaggcgagtgtgcggctccttctaccggcttaaagggcctcagttttcggtgggatggcagcggtatttggttgcagccggcaggacggaaatgtagggagtgggccgcagtggccccaggggaggctgggagacgcccggcggccgcgtggcgggggagggttgctgcatcggtttgcctggcgcgcggggaagtggagccagcgttttctttcacccagttccctgcttagtccagtcccaccgtggttcttcagagctgttcttggcgtgcttccagtatgggggtacattccggagtagttaaaagcccgttgactcccgggggcactggcacctggcgagggaggggaacagacagtgctcagttcggggtaagaccacgtgttgagcaacgccccacgccgtctgggtagatgggtccttcatctagggcgtgctctgctgcggttggcacggcaacctggactgcagcactagttctggacctcgcgcgtgcttagacaggaggtgatgggcactattacctcttggcagtggccatacgtttttcctggttaagtgttctgttaagggatgagggaaatattttgattaattgaatttttaaaccagatttttctttttttcagcaaccgccaccatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgggaggcggaggatctggcggcggaggaagtggcggaggcggaagcggtggtggtggatctgggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagcgtttcagacaaaaagatgatgggaaatgccccttgaatcctcacagccacctaggaacatatggagtttttacaaacgctgcatttgacccgagtcctggaagcggacagtgtactaattatgctctcttgaaattggctggagatgttgagagcaaccctggacctatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgtggaagcggagagggcagaggaagtctgctaacatgcggtgacgtcgaggagaatcctggacctatgcttggggtcctggtccttggcgcgctggccctggccggcctgggattccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcaactgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgatagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattcgttttgtgcagaaattttaaggtgactacacgcttagcccaactacccttgggaaatgtgtgtgtgttagtcactcaatcgtgtccagctctttgtgaccccatggactgtagcctgccaggctcctctgtccatgggattctccaggcaagaatactggagtgggttgccattccccaggggattttcccaacccaaggatcaaacccgagtttcctgcattgcaggcagattctttactctctgagccatcagggaagccctgtgggaaatgggaaccatgcaaaaacggctttgggaccaataagaccagaatatttgggatctgaactggcgcaagaaatgtggaagagagattctaaatgcatgtgtacatactaagttgcttcagtcatgtccgactatttgcaaccccatggaccacagcctgccaggctcctctgtccatgggattctccagtcaagaatactggagtgagtttccatttcctcttccaggggatcttccagacccagggatcaaaccagtgtctcttatgtctcctgtgttgacaggcaggttctttaccactagtgccacctgagacccaattctaaacgaggggttgcaaattcagtgccaacaggtgccaggtataagtggcaagggctgcatgtgaagggagaaatagcaaccagcccttaggctgcttgtgaaggatacagcacagaggggtgggaaccagggcagcctgaagtctcaggccccagctaaggatgtggcccagccagccttgttacattgcctgatcctgcattcaggactgcaggaggactttcctggtggtccagtggttgagaatccacatgccaatgcaggggacacgggttcaatccctgatctgggaagattccacatgcctcagggcaactacgcccgtacatcacaactaccgaagccctcgcacctagagcctgtgctctgcaacaggagaagccactcagggagaagcctgctcaccacaactagaaagtacagtagcccctgctcgctgcaactggagaaagccctcttgcagcaaccaacacccagcacagccaaaactaaatatatatatattttaaaagacctcaggggacttccctggtggttcagcgtgtaaggctctgtgtttccaatggagggggcccaggttcaacccctggttggagaactagatccctcatgctgaaattaaagatcccaagtgctgcaacctgactcagccaaaaaaaaaaaaaaaagctcagatgcagggctgccagaccttctgattctttgagacagacagggtatctagactttcatgtaaaatcaaatgtttacacattggcaactaattcatagtgaaaacattttaagggcaaaatttaacccaaacacatttgctcttcaagctgtcagtgagcaatttgttattagaggaatggattgggataacttgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagtagtaactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgactcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccgcggcatccctgcaagggatcctcacccccttttcttccttcattctctgctggtgtcaatcacagcttctagcagagggaaggcaggccaggcttggtttcttcttgcgagagtatttaactcagggccctgtagaacaatgagaatctgacctgcaactagctgggcgtgctggggcatgcctgtgtagtttcagctacttgggaggctgaggcaggagaattgcttgagcccaaagttgaggctgcagtgagccatggttgtgccattacactccagcctgggcaacacaagacccctgctcagaaataaaaagagaacctggcctgcagtgccaggcaggccctgaggtccaggagcctgggtatctccctctgcagcatgggtcacgaacaaactgggccctcagaggccacgggatggcgcccagtctccagtcacaaggcagaatccagacctcagcccatagctaaccagagctgtctgcaggccagatatggccccatggaccccctaccccaacttgactttgattccaggtccccctccgtctggatgaacaggtaggaattgcggcctctcctaagcctatgggagcctgggccaggctgaccctcaaggctgacagccacgatcccataggtgaaggcaaaggcgtggcagctaggaacacccactacacccccactcaagggaacaccgtgcccagctaccctgagacagccccactcccaggaaatgcaggtgccaaccagccccagtgaggcatggcacctgagccagacacccccaaatagtcccttcccacctcctcaagcatctgcactctgggtgaacccagaaaaactggggtacctggggagacatagaagggccaggccaggaactccccaataagcaggaacaggaacctgacccctgagcctcccccaccctctaaggctgctcaatgtcaaggcaggagggatctccacacacctgcactctgggtaaggacaagttggcccccactgccccacccttttgcagggttcaccctcctgcagggttcaccctctgctgcccccaacccagccacaccacaaagtcacacttggcctcaagagaaatgttctggcacctgcacttgcactggggacagcctattttgctagtttgttttgtttcgttttgttttgatggagagcgtatgttagtactatcgattcacacaaaaaaccaacacacagatgtaatgaaaataaagatattttatt

SEQ ID NO: 212 - DNA, 24681 bp, synthetic construct
  misc_feature 1..24681: note = 15S4
  source 1..24681: mol_type = other DNA
ggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatcggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgggaggcggaggatctggcggcggaggaagtggcggaggcggaagcggtggtggtggatctgggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagcgtttcagacaaaaagatgatgggaaatgccccttgaatcctcacagccacctaggaacatatggagtttttacaaacgctgcatttgacccgagtcctggaagcggacagtgtactaattatgctctcttgaaattggctggagatgttgagagcaaccctggacctatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgtggaagcggagagggcagaggaagtctgctaacatgcggtgacgtcgaggagaatcctggacctatgcttggggtcctggtccttggcgcgctggccctggccggcctgggattccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcaactgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactatcagttattcctaggaggttgtatagtcttctgattggaagccacaaatttcatataaactagtccaagtaattgtgctagagctaagatactcaaacctgaaatcagaagagggccatgcattggtatacacgccgcaatacagagactcagtccaaccacagcgaggatataggctatcacctgaataaccaatatggcaatgacgaaggaggttaatccaatcgctgtactaaacacatagtagtgaagtaatattaatatccctgtagaagtcacaattaaaccaaggccagtagcattctttaatgaatattcacctgggacgaaaagaatggctccaacaatgacaatgacagtgatcactagtccagcaacaagtaaagcaattgttttctcatccataccaccggatctatatttaagtgttttaataccaaactgtccccagaacaggagtatagcaaaaattgggaaaataacaataagaatattttcatttggagaaaaccatgaaacaacacgatattttagctcgatgatcgtttcaccttctctggttaattctgttacttcacaagtgtagtttcctgtgtgtgagacagcatcactcttatccatcttcaaagaggcatctccttttagtaattgtgagacttcaatttttgcactactaaagtcagtggggacagtggacttgtttagagctccatcaaaggtgtaaatatctcttcctttaaatttccactttacgtatacttcagtagtgttttgtgcctccatattagtaacaaagcatggaatgacgacagtgtcattacaaaacgtgaattctacagattttgttttattaaatagtagctgagctgatccgcagcacgccgagcccagcaacagcgccgctaccaggggccacataggtccagggttctcctccacgtctccagcctgcttcagcaggctgaagttagtagctccgcttcccaagctgtgagactcagacccctgggcactgtcgctccactcagccttagagtagctccctccttttccacctgagctcttcttcctccatatcacagcagcaaccacagctccagagaccacagatccaaggagaaccaggccagcaatgatgcccacgatggggatggtgggctgggaagccggcttccatctcagggtgacgggctcgggtagcccctcatgctgcacatggcacgtgtatctctgctcctctccagaaggcaccaccacagctgcccacttctggaaggttccatcccctgcaggcctggtctccacgagctccgtgtcctgggtatggccctccccatcctgctgccaggtcagtgtgatctccgcagggtagaagcccagggcccagcacctcagggtggcctcatggtcagagatggggtggtgagtcacgtgtgtctttgggggctccaggtgaagcagcgtctccttccccttctccaggtatttgtggagccactccacgcatgtgtcttccaggtaggctctctggtgctccgcctcagaggcatcatttgacttttgctcggagatctgagccgccgtgtccaccgcggtccaggagcgcaggtcctcattcagggtgagataatccttgccgtcgtaggcgaactgttcatacccgcggaggaagcgcccgtcgggccccagctcgcagccatgcatccactgcagggtgtgagacccggcctcgctctgattgtagcagccgcgcagcgtccgcagattcactcggaaaatctgtgcggtgtccctggcgctccgtgtctcccggtcccaatactctgacccctcctgctccatccacggcgcccgcggcaccatcctcggactcgcggcgtcgttgtcgaagcgcacgaactgggtgtcgtccacgtagcccacagagatgaagcggggctccccgcggccgggccgggacacggaagtgtggaaatacttcaaggagtgagatccggaaccgccaccaccgcttcctccgccgccactaccgccaccaccagaaccgccaccacccatgtcgcgatcccacttaactatcttgggctgtgacaaagtcacatggttcacacggcaggcatactcatctttttcagtgggggtgaattcagtgtagtacaagagatagaaagaccagtccttgctgaaagacaagtctgaatgctccactttttcaattctctctccattcttcagtaagtcaacttcaatgtcggatggatgaaacccagacacatagcaattcaggaaatttgactttccattctctgctggatgacgtgagtaaacctgaatctttggcgtacgctggatggagccgccaccaccagaaccgccaccaccggaaccgccgcaacccaggaagagggttcggggcgccatgacagcctcgaggccagaaagagagagtagcgcgagcacagctaaggccacggagcgagacatggtggcttttgcttagcttttagcgatggctttcacgacacctaagacgacaaaaaccttctttaaactactgtcccgacgaccggagactcaggcacaaccccaacagccaagggcaaactccagggagcattagcaccggcgccctgcgggccctgcccggcctacacccagcgaacggggccgccccggcgcccagcccctcccccacccgggccgcgagtcccgggaagcggcgcgggcagcaccgcccggccctttgtgcgccgcccgccgtccgcgtcctccatcttgagaccgggagcggccatctttccgcgctcgcagcccgcccgggcggggcgctgggtctccgaccgcccgccccgccccgccgcggccgtctgccccgggaccgccgggcacggaggccaccttgggcggcctcggctgggccgccctggcagtaacacgcggctgccggccgaactcgagcgcgaagacagacggggcgggcgcgaaggcgcggatcgcacgcggcggccacggcgccccagcaggccgccaccgggcacgcggtagggaaccgcgagagcggagggcctcgagttctccacctccccccgcccgcagctcggaatcaggaccagggcgcagagccctctacgcgcggggggccgggaggcacgctaaggccgtggccaccggcggaggccatgcggacggaggccacacccgtactcacctgtgtcctggcggcaaacccgttgcgaaaaagaacgttcgcggggaccacggcgcttatatatggtcctcccccaccctcggggaaaagggcggagccagcacacgacaccactttcccagtttaccccgcgccacctccacccggcaccggttccaccgccgtcccctccccccatcttcggggaccgtgggcgatgtgcgttcagcccactgacgagcacacggcgcccggcgcatgctcctctcaaccaggaggatgacgactgctggtgggtgggaggcggggtcgagcgctcactcggttctaggtttagtgggagtttatcgacggtccctgggatttccctggctgaggagagtcctccttttgtatgaattactctccgcacagctggggggtggggcggcggggaggcgtccagaatcttccctgaaccggtcgtagcttaactgcaaagttggaccgagatgggagcccttacccggcagtaccccaccggtcctcagtcttgcggtctcgcaggttaaggactaacccctggagccgcttcctctgccggggcttctccaccgcccttgccgtccgcgccccttccggctggagagggaggcgtaaaaggccggggaaccgcggcggcaggggcctcggggcggtcttcagggccgagaatccgcgagtggctcagtttgctgaccaacagcctggcgaacaggctcctgcgctgacctcttggctttttccattcagttcttttatctaagttcgttctacacaccacgtggtactccagacgtccagtttttgagtttagaatagacttaagtactacagttttctttacttctaatcctaattttattacgtttaagaccctgagtgtgtgtctaccctcctattaacattttttttccagtgtatactcttggttgcaagcatgaaaaacctaaaaagaattttttgagttcagtgcttatacacgatctcaagtagagactaagatctacagcgccaggaagcttatccacccaatttactactccaacgtttgctgtgaaatcactgtttctcaaaaatggcctatcccatttgaataaacggcttcatcttttgtcgtcctatccattgtgactgcattttaggcataaatccagggcaagacaagatgaggcctttttggttggcaatcaggcagatattcaaaaatattcctgaagaaagaggaacctttattttaaatgagctaattactagatcgtctcttccacgtgtagagcactactgcaactttttgagccaatctatcaacaaatatttgagaacctactatgtggccagagctaagagtggctccgaagcatatgcaaaagaaatacttcctttgggggaagaaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagtaactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgactcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccgcggcatccctgcaagggatcctcacccccttttcttccttcattctctgctggtgtcaatcacagcttctagcagagggaaggcaggccaggcttggtttcttcttgcgagagtatttaactcagggccctgtagaacaatgagaatctgacctgcaactagctgggcgtgctggggcatgcctgtgtagtttcagctacttgggaggctgaggcaggagaattgcttgagcccaaagttgaggctgcagtgagccatggttgtgccattacactccagcctgggcaacacaagacccctgctcagaaataaaaagagaacctggcctgcagtgccaggcaggccctgaggtccaggagcctgggtatctccctctgcagcatgggtcacgaacaaactgggccctcagaggccacgggatggcgcccagtctccagtcacaaggcagaatccagacctcagcccatagctaaccagagctgtctgcaggccagatatggccccatggaccccctaccccaacttgactttgattccaggtccccctccgtctggatgaacaggtaggaattgcggcctctcctaagcctatgggagcctgggccaggctgaccctcaaggctgacagccacgatcccataggtgaaggcaaaggcgtggcagctaggaacacccactacacccccactcaagggaacaccgtgcccagctaccctgagacagccccactcccaggaaatgcaggtgccaaccagccccagtgaggcatggcacctgagccagacacccccaaatagtcccttcccacctcctcaagcatctgcactctgggtgaacccagaaaaactggggtacctggggagacatagaagggccaggccaggaactccccaataagcaggaacaggaacctgacccctgagcctcccccaccctctaaggctgctcaatgtcaaggcaggagggatctccacacacctgcactctgggtaaggacaagttggcccccactgccccacccttttgcagggttcaccctcctgcagggttcaccctctgctgcccccaacccagccacaccacaaagtcacacttggcctcaagagaaatgttctggcacctgcacttgcactggggacagcctattttgctagtttgttttgtttcgttttgttttgatggagagcgtatgttagtactatcgattcacacaaaaaaccaacacacagatgtaatgaaaataaagatattttatt

SEQ ID NO: 213 - DNA, 28955 bp, synthetic construct
  misc_feature 1..28955: note = 16M
  source 1..28955: mol_type = other DNA
cggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgaggcacacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcaccccgcacccggcgctcacccgtcccagccccgccgcccgcagccccagctgcaacgcagccaccgccgccatcgcacccggccccgcgggcgcttccgggacgcaggaagcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaagggggcgcggcaggagggggcaccagggagcggagccctggccctcctgacgtcctgcccgcccacgcgtccgcaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgtaggtggtctgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccaccatgtctcgctccgtggccttagctgtgctcgcgctactctctctttctggcctcgaggctgttatggctccgcggactttaattttaggttgcggcgcttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattactataccatatctttccagaaatatgaaggcttgtgaaagataagcaagcctatgatggccactgtgaaaaggaccagggagaatagaaccatgaggaagacataggtggagtgggagagaggtgtggacaatggttgctcagctgggatcatgttggtcaggttcagcatgtagcccaaagtccagccggcgtcgctgccctggatcttgccaatgaaatggatgtgctcccaggaatcagctgtgaaatgatagccttgcagaaggagggagagaatgtaggtaccagaaaagcagtattcactcaggtacttctcctttactccagcgtaagatgtttttatctcctcccaaggctgagcacagaactttttcatcatctcagtcaccttttcctgagagactttctctgatgtcaagtttaaaaacttcatcacaaagtaaaaagctgaaaatgccccaaaatccccctggagtggtggcaagaaaatcccattgaaggcacactgggagtaagggcagtaactggtgttgaagagctccaggatgctttgatggcattgttgatagtttccaataccctggatttcaaactgctggaatggaagagtcatctcaaatctcttggtgcagggggtcttgtaaaggtcacttacgttcactaccttcttatatccaggatgaaagcatgggtccctgagaatttcattacttgcaacctgaatgtccttggccagtttctgccagagtgcctgatccttcccatagcacaagaagctatgtgtgtagacattgtagtccttgccatagaggcgaaattgcagagcattatctggggactcgatagtctggttttggggtacaaaagtgacttgtgtagaggctcccccaaggtccaaagctccaaaggtttcctgattattggtttcatatgggactatgctgaaccaccttgttttctgactgaatttgcccagcagatagttgatagtaatccagccataggcaccttcctcttggccagtaatgatcctggcaccctggaagtcaaaggggtagttgctgaggctcctctccaccacatccagaaccctgtctgccaactcttcactttccatcctgagcaaccgcatgcctgccgtggctcccaggtaaacgggtgtctcttggtgctgggaccttggaatcacttccctagctctttccatgcaatcagtcaggtaaatgcctatttcatttactttctgaacaaattttgagattccaggacctttaaccctgcattcttctacttgatgcaccacgcctgtgtcattctccttttctgctggccacttatagatgtataaacttgtgtgagaagaacccgcatccagcacaatcccatacttaacgttttctggcaatgctttgttctgggtcaaccccacagcaagcaaagctatcacagctatgatagaggagaagccaaggatggctaggatattcttggagcaaaatgtcttcacgttagactcctttgtatcttccataggtccagggttgctctcaacatctccagccaatttcaagagagcataattagtacactgtccgcttccgagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagctgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaaccccaggccggccagggccagcgcgccaaggaccaggaccccaagcataggcccaggattctcctccacgtcgccagcctgctttaacaggctaaaattggtggcgccactgccaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggctcacgacacctgaaatggaagaaaaaaactttgaaccactgtctgaggcttgagaatgaaccaagatccaaactcaaaaagggcaaattccaaggagaattacatcaagtgccaagctggcctaacttcagtctccacccactcagtgtggggaaactccatcgcataaaacccctccccccaacctaaagacgacgtactccaaaagctcgagaactaatcgaggtgcctggacggcgcccggtactccgtggagtcacatgaagcgacggctgaggacggaaaggcccttttcctttgtgtgggtgactcacccgcccgctctcccgagcgccgcgtcctccattttgagctccctgcagcagggccgggaagcggccatctttccgctcacgcaactggtgccgaccgggccagccttgccgcccagggcggggcgatacacggcggcgcgaggccaggcaccagagcaggccggccagcttgagactacccccgtccgattctcggtggccgcgctcgcaggccccgcctcgccgaacatgtgcgctgggacgcacgggccccgtcgccgcccgcggccccaaaaaccgaaataccagtgtgcagatcttggcccgcatttacaagactatcttgccagaaaaaaagcgtcgcagcaggtcatcaaaaattttaaatggctagagacttatcgaaagcagcgagacaggcgcgaaggtgccaccagattcgcacgcggcggccccagcgcccaagccaggcctcaactcaagcacgaggcgaaggggctccttaagcgcaaggcctcgaactctcccacccacttccaacccgaagctcgggatcaagaatcacgtactgcagccaggggcgtggaagtaattcaaggcacgcaagggccataacccgtaaagaggccaggcccgcgggaaccacacacggcacttacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagcctcaccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctcccccacggaggcggctggccgacttccactgaggcgccaacggcctcgccatgcccttttcaataactcattgatttcaaacccgttacgtctatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcacttcatctgcaacgagggttactacctgattggtgaggagatcctgtattgtgaacttaaaggatcagtagcaatttggagcggtaagcccccaatatgtgagaaggtcttgtgtacaccacctccaaagatcaagaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgactggcagtggagccaccaacttctcactccttaagcaggctggcgacgtggaggagaaccccgggcctatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctgataacccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgattatatggccacaaccatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggcggcagcggcgccaccaatttctcactactgaaacaggccggtgacgtcgaggagaaccccgggcctatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgggaagcggagagggcagaggaagtctgctaacatgcggtgacgtcgaggagaatcctggacctatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaatagaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacggagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccg

SEQ ID NO: 214 - DNA, 22051 bp, synthetic construct
  misc_feature 1..22051: note = 16P
  source 1..22051: mol_type = other DNA
cggggacagcccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccagcagcccagactgcccagagccacatccagcctggccttgaatgcctgcagggatggggcatccacagcctccttgggcaacctgttcagtgcgtcaccaccctctggggggaaaacttcctcctcatatccaacctaaacctcccctgtctcagtttaaagccattccctcctgtcctatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgaggcacacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcaccccgcacccggcgctcacccgtcccagccccgccgcccgcagccccagctgcaacgcagccaccgccgccatcgcacccggccccgcgggcgcttccgggacgcaggaagcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaagggggcgcggcaggagggggcaccagggagcggagccctggccctcctgacgtcctgcccgcccacgcgtccgcaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgtaggtggtctgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccaccatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgggaggcggaggatctggcggcggaggaagtggcggaggcggaagcggtggtggtggatctgggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagcgtttcagacaaaaagatgatgggaaatgccccttgaatcctcacagccacctaggaacatatggagtttttacaaacgctgcatttgacccgagtcctggcagtggcgccaccaattttagcctgttaaagcaggctggcgacgtggaggagaatcctgggcctatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctaagctcgctttcttgctgtccaatttctattaaaggttcctttgttccccaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaagggggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagctttttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattaagtcagcaagcccatggttactagcgtcccaagcaaacctgtcaacgtgaaacacgtgtgcccagatagaagacgggtagtacctgaagtggttccacttcctttatttggggttgtttcatgaaaatgcttggttgtcctggaaacaggtgtactccgtgttgcttgagcatttggtgtggtggtttttgtggtggttttctgagaagttggtgagacttctgtagttggaacatttactgtggtaggtttctgaactgttggtgggaccttggaagttagagattttcctctgcattcaggtggtgggccactccactctccttcatcattattcacagtacaataaatagagtgctctccaatcatggtgaatcctttattacatgcatacgttacagactgtctatatccataatggtcacgttccccttgaattattccattgtcaatttgtggtggtgctggacaataaatttctctgcactctggcaacgggtcactccactggacagagctgcctgaaataagacaaaaactagaagtcgagccaaataatttgtaccctgtgttacatgagaaggagatggttgcaccaaataatatgccacctggtacatcaatctgaccatttcgtatttctcccggattagggcatgatttctttttacaaaattcgactgctgtggaccattttaaattctgaaggcaagttagttttggtgatagagaaggttctcttctgtaacctggacggcactcatattccacaacagtaccgactggaaaataattctgagtgatataaggctgtttgagggatgcagaatttagccttgttggcacctcgcagctacgattgcagaactcttcaatatctgaccattgactgcccttaaggcagatcactgagtccttctcgccaggaattttcacaaagctttcttcacatttgtacgttattacagtatcctcgggaaaacttgtacggccttccaaagctggctgggcattaggtacatctgggggaaggccacagtcaccccacacggccggcaggcacaacagcaccagcagcagcagccggggcagctccccgaggaggggcagcgccgcgggcacgctcggccgcgcgacggtcataggtccagggttggactccacgtctcccgccaacttgagaaggtcaaaattcaaagtctgtttcactccgcttccgagagaagtaaattttacttctctgtgggtctcatcagttaggtatgtgcctttcttcttcctcctttgaagatatcggtacgggacaacacaaattactgcaactccaacaactatggcaataacaatcacagcaatgacccaaacatccaaactgtcaagtattccttcctcaggtttaggatatcctggataatttgagactggaggcttgtaagtaggcctaggacctgaggcactggacgctggagattttgtagtggaagaagtcgacactgaatgactcaaagctggaggttttgtactagatggaggcagcactttaagacactttggaactgggggatcccaagtactgttactgtcacagacaattgtgtcgctgccatcgaggtaaaaacccttatcgcattcaaacataactgttgctttgtagtaaaatttttttccaaatcctgatatctgttttccattttcgactactggaaatcgacatttgaccactttacactctggagcagcacgactccacactgaattgtcaccacaataaatcgtgctctctccaataagtgaaaatggatctggtccaggtgcaggatcacaactataagttactgcatcaagatactcaaatacttctacttcactaaaggtgtgttttccattcttgatctttggaggtggtgtacacaagaccttctcacatattgggggcttaccgctccaaattgctactgatcctttaagttcacaatacaggatctcctcaccaatcaggtagtaaccctcgttgcagatgaagtgcatctgataaccaaactcgtaagtcccatttgcagggactgcttggccatttaaaggatcccgtatatatggacatgtttctctataacaggcgtcatctgagacaggtagccatgtatgattccgatcacaaatagtatgggtggcaagaggaggtatatagaagtatccttttttacacttataatctactcgttcaccaatctcatagtagggttttggtttgccgatgagctccatagcttcaaatgttggtggctcctcacaggcatcggagaaggagtacagcagcaacaccatggccgccagaagcaacccaggaaagcgccaggaaggaaagggacactcgcggcggccgggaggctccatggtggctcacgacacctgaaatggaagaaaaaaactttgaaccactgtctgaggcttgagaatgaaccaagatccaaactcaaaaagggcaaattccaaggagaattacatcaagtgccaagctggcctaacttcagtctccacccactcagtgtggggaaactccatcgcataaaacccctccccccaacctaaagacgacgtactccaaaagctcgagaactaatcgaggtgcctggacggcgcccggtactccgtggagtcacatgaagcgacggctgaggacggaaaggcccttttcctttgtgtgggtgactcacccgcccgctctcccgagcgccgcgtcctccattttgagctccctgcagcagggccgggaagcggccatctttccgctcacgcaactggtgccgaccgggccagccttgccgcccagggcggggcgatacacggcggcgcgaggccaggcaccagagcaggccggccagcttgagactacccccgtccgattctcggtggccgcgctcgcaggccccgcctcgccgaacatgtgcgctgggacgcacgggccccgtcgccgcccgcggccccaaaaaccgaaataccagtgtgcagatcttggcccgcatttacaagactatcttgccagaaaaaaagcgtcgcagcaggtcatcaaaaattttaaatggctagagacttatcgaaagcagcgagacaggcgcgaaggtgccaccagattcgcacgcggcggccccagcgcccaggccaggcctcaactcaagcacgaggcgaaggggctccttaagcgcaaggcctcgaactctcccacccacttccaacccgaagctcgggatcaagaatcacgtactgcagccaggtggaagtaattcaaggcacgcaagggccataacccgtaaagaggccaggcccgcgggaaccacacacggcacttacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagcctcaggcaccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctcccccacggaggcggctggccgacttccactgaggcgccaacggcctcgccatgcccttttcaataactcattgatttcaaacccgttacgtctatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggccagcgtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgtctcgctccgtggccttagctgtgctcgcgctactctctctttctggcctcgaggctgttatggctccgcggactttaattttaggttgcggcgcttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataaaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacagagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaatgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccg

SEQ ID NO: 215 - DNA, 24797 bp, synthetic construct
  misc_feature 1..24797: note = 16S
  source 1..24797: mol_type = other DNA
cggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgaggcacacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcaccccgcacccggcgctcacccgtcccagccccgccgcccgcagccccagctgcaacgcagccaccgccgccatcgcacccggccccgcgggcgcttccgggacgcaggaagcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaagggggcgcggcaggagggggcaccagggagcggagccctggccctcctgacgtcctgcccgcccacgcgtccgcaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgtaggtggtctgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccaccatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgtggaagcggagctactaacttcagcctgctgaagcaggctggagacgtggaggagaaccctggacctatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattaagtcagcaagcccatggttactagcgtcccaagcaaacctgtcaacgtgaaacacgtgtgcccagatagaagacgggtagtacctgaagtggttccacttcctttatttggggttgtttcatgaaaatgcttggttgtcctggaaacaggtgtactccgtgttgcttgagcatttggtgtggtggtttttgtggtggttttctgagaagttggtgagacttctgtagttggaacatttactgtggtaggtttctgaactgttggtgggaccttggaagttagagattttcctctgcattcaggtggtgggccactccactctccttcatcattattcacagtacaataaatagagtgctctccaatcatggtgaatcctttattacatgcatacgttacagactgtctatatccataatggtcacgttccccttgaattattccattgtcaatttgtggtggtgctggacaataaatttctctgcactctggcaacgggtcactccactggacagagctgcctgaaataagacaaaaactagaagtcgagccaaataatttgtaccctgtgttacatgagaaggagatggttgcaccaaataatatgccacctggtacatcaatctgaccatttcgtatttctcccggattagggcatgatttctttttacaaaattcgactgctgtggaccattttaaattctgaaggcaagttagttttggtgatagagaaggttctcttctgtaacctggacggcactcatattccacaacagtaccgactggaaaataattctgagtgatataaggctgtttgagggatgcagaatttagccttgttggcacctcgcagctacgattgcagaactcttcaatatctgaccattgactgcccttaaggcagatcactgagtccttctcgccaggaattttcacaaagctttcttcacatttgtacgttattacagtatcctcgggaaaacttgtacggccttccaaagctggctgggcattaggtacatctgggggaaggccacagtcaccccacacggccggcaggcacaacagcaccagcagcagcagccggggcagctccccgaggaggggcagcgccgcgggcacgctcggccgcgcgacggtcataggtccagggttggactccacgtctcccgccaacttgagaaggtcaaaattcaaagtctgtttcactccgcttccgagagaagtaaattttacttctctgtgggtctcatcagttaggtatgtgcctttcttcttcctcctttgaagatatcggtacgggacaacacaaattactgcaactccaacaactatggcaataacaatcacagcaatgacccaaacatccaaactgtcaagtattccttcctcaggtttaggatatcctggataatttgagactggaggcttgtaagtaggcctaggacctgaggcactggacgctggagattttgtagtggaagaagtcgacactgaatgactcaaagctggaggttttgtactagatggaggcagcactttaagacactttggaactgggggatcccaagtactgttactgtcacagacaattgtgtcgctgccatcgaggtaaaaacccttatcgcattcaaacataactgttgctttgtagtaaaatttttttccaaatcctgatatctgttttccattttcgactactggaaatcgacatttgaccactttacactctggagcagcacgactccacactgaattgtcaccacaataaatcgtgctctctccaataagtgaaaatggatctggtccaggtgcaggatcacaactataagttactgcatcaagatactcaaatacttctacttcactaaaggtgtgttttccattcttgatctttggaggtggtgtacacaagaccttctcacatattgggggcttaccgctccaaattgctactgatcctttaagttcacaatacaggatctcctcaccaatcaggtagtaaccctcgttgcagatgaagtgcatctgataaccaaactcgtaagtcccatttgcagggactgcttggccatttaaaggatcccgtatatatggacatgtttctctataacaggcgtcatctgagacaggtagccatgtatgattccgatcacaaatagtatgggtggcaagaggaggtatatagaagtatccttttttacacttataatctactcgttcaccaatctcatagtagggttttggtttgccgatgagctccatagcttcaaatgttggtggctcctcacaggcatcggagaaggagtacagcagcaacaccatggccgccagaagcaacccaggaaagcgccaggaaggaaagggacactcgcggcggccgggaggctccatggtggctcacgacacctgaaatggaagaaaaaaactttgaaccactgtctgaggcttgagaatgaaccaagatccaaactcaaaaagggcaaattccaaggagaattacatcaagtgccaagctggcctaacttcagtctccacccactcagtgtggggaaactccatcgcataaaacccctccccccaacctaaagacgacgtactccaaaagctcgagaactaatcgaggtgcctggacggcgcccggtactccgtggagtcacatgaagcgacggctgaggacggaaaggcccttttcctttgtgtgggtgactcacccgcccgctctcccgagcgccgcgtcctccattttgagctccctgcagcagggccgggaagcggccatctttccgctcacgcaactggtgccgaccgggccagccttgccgcccagggcggggcgatacacggcggcgcgaggccaggcaccagagcaggccggccagcttgagactacccccgtccgattctcggtggccgcgctcgcaggccccgcctcgccgaacatgtgcgctgggacgcacgggccccgtcgccgcccgcggccccaaaaaccgaaataccagtgtgcagatcttggcccgcatttacaagactatcttgccagaaaaaaagcgtcgcagcaggtcatcaaaaattttaaatggctagagacttatcgaaagcagcgagacaggcgcgaaggtgccaccagattcgcacgcggcggccccagcgcccaagccaggcctcaactcaagcacgaggcgaaggggctccttaagcgcaaggcctcgaactctcccacccacttccaacccgaagctcgggatcaagaatcacgtactgcagccaggggcgtggaagtaattcaaggcacgcaagggccataacccgtaaagaggccaggcccgcgggaaccacacacggcacttacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagcctcaccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctcccccacggaggcggctggccgacttccactgaggcgccaacggcctcgccatgcccttttcaataactcattgatttcaaacccgttacgtctatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgtctcgctccgtggccttagctgtgctcgcgctactctctctttctggcctcgaggctgttatggctccgcggactttaattttaggttgcggcgcttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagagggcagaggaagtctgctaacatgcggtgacgtcgaggagaatcctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaatgataacccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgattatatggccacaaccatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggcggcagcggcgccaccaatttctcactactgaaacaggccggtgacgtcgaggagaaccccgggcctatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgtgataaaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacggagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccg

SEQ ID NO: 216 - DNA, 30340 bp, synthetic construct
  misc_feature 1..30340: note = 17M1
  source 1..30340: mol_type = other DNA
cggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgaggcacacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcaccccgcacccggcgctcacccgtcccagccccgccgcccgcagccccagctgcaacgcagccaccgccgccatcgcacccggccccgcgggcgcttccgggacgcaggaagcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaagggggcgcggcaggagggggcaccagggagcggagccctggccctcctgacgtcctgcccgcccacgcgtccgcaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgtaggtggtcctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactactataccatatctttccagaaatatgaaggcttgtgaaagataagcaagcctatgatggccactgtgaaaaggaccagggagaatagaaccatgaggaagacataggtggagtgggagagaggtgtggacaatggttgctcagctgggatcatgttggtcaggttcagcatgtagcccaaagtccagccggcgtcgctgccctggatcttgccaatgaaatggatgtgctcccaggaatcagctgtgaaatgatagccttgcagaaggagggagagaatgtaggtaccagaaaagcagtattcactcaggtacttctcctttactccagcgtaagatgtttttatctcctcccaaggctgagcacagaactttttcatcatctcagtcaccttttcctgagagactttctctgatgtcaagtttaaaaacttcatcacaaagtaaaaagctgaaaatgccccaaaatccccctggagtggtggcaagaaaatcccattgaaggcacactgggagtaagggcagtaactggtgttgaagagctccaggatgctttgatggcattgttgatagtttccaataccctggatttcaaactgctggaatggaagagtcatctcaaatctcttggtgcagggggtcttgtaaaggtcacttacgttcactaccttcttatatccaggatgaaagcatgggtccctgagaatttcattacttgcaacctgaatgtccttggccagtttctgccagagtgcctgatccttcccatagcacaagaagctatgtgtgtagacattgtagtccttgccatagaggcgaaattgcagagcattatctggggactcgatagtctggttttggggtacaaaagtgacttgtgtagaggctcccccaaggtccaaagctccaaaggtttcctgattattggtttcatatgggactatgctgaaccaccttgttttctgactgaatttgcccagcagatagttgatagtaatccagccataggcaccttcctcttggccagtaatgatcctggcaccctggaagtcaaaggggtagttgctgaggctcctctccaccacatccagaaccctgtctgccaactcttcactttccatcctgagcaaccgcatgcctgccgtggctcccaggtaaacgggtgtctcttggtgctgggaccttggaatcacttccctagctctttccatgcaatcagtcaggtaaatgcctatttcatttactttctgaacaaattttgagattccaggacctttaaccctgcattcttctacttgatgcaccacgcctgtgtcattctccttttctgctggccacttatagatgtataaacttgtgtgagaagaacccgcatccagcacaatcccatacttaacgttttctggcaatgctttgttctgggtcaaccccacagcaagcaaagctatcacagctatgatagaggagaagccaaggatggctaggatattcttggagcaaaatgtcttcacgttagactcctttgtatcttccataggtccagggttgctctcaacatctccagccaatttcaagagagcataattagtacactgtccgcttccgagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagctgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaaccccaggccggccagggccagcgcgccaaggaccaggaccccaagcataggcccaggattctcctccacgtcgccagcctgctttaacaggctaaaattggtggcgccactgccaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcggttgctgaaaaaaagaaaaatctggtttaaaaattcaattaatcaaaatatttccctcatcccttaacagaacacttaaccaggaaaaacgtatggccactgccaagaggtaatagtgcccatcacctcctgtctaagcacgcgcgaggtccagaactagtgctgcagtccaggttgccgtgccaaccgcagcagagcacgccctagatgaaggacccatctacccagacggcgtggggcgttgctcaacacgtggtcttaccccgaactgagcactgtctgttcccctccctcgccaggtgccagtgcccccgggagtcaacgggcttttaactactccggaatgtacccccatactggaagcacgccaagaacagctctgaagaaccacggtgggactggactaagcagggaactgggtgaaagaaaacgctggctccacttccccgcgcgccaggcaaaccgatgcagcaaccctcccccgccacgcggccgccgggcgtctcccagcctcccctggggccactgcggcccactccctacatttccgtcctgccggctgcaaccaaataccgctgccatcccaccgaaaactgaggccctttaagccggtagaaggagccgcacactcgcctcgacgagattctcagaacccccaagcctcagcaagcccaacaggcctgtgtggaggctgcacgctcccagacccacaacccaactcttgagcagaggttttacctggggtgtaggcctggctccaataacgaaggaagccacaaaaaacccaagagctgcaggcgagttcaatgagaccggtttccgcccgccaccctgcctcttataccctatcttagaaccttccagaaggggcccgcccctgctgcctgccattacggcttccccggccaatagacgcccggctgcccttacaagacccaatcacaagcccggctccactcctcgggcctcgcccccttccgcacccaccccaccgcgctccgcctcacgataacgcactcaccgcagcgttctggaactttcaagctcgcccccgctctccggacggccccggggaaagggagggtggggcgcagcgagtccgcgcgcgggagtcctcagttaccccgggcgggggaggggagcgtccacctctacgcatgcgcccccagcttccgcgggagggagggggcggaaaaaggaggaggaagaggggcgggcaaacttggaactaaccaatgatagcggcgctagccgggatcttggccggcacagaactgggggcggaatcgcgcggggcctgaagggaggggtttgggcgcgggagccgggccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctcccccacggaggcggctggccgacttccactgaggcgccaacggcctcgccatgcccttttcaataactcattgatttcaaacccgttacgtctatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgactggcagtggagccaccaacttctcactccttaagcaggctggcgacgtggaggagaaccccgggcctatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctgatagcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgattatatggccacaaccatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggcggcagcggcgccaccaatttctcactactgaaacaggccggtgacgtcgaggagaaccccgggcctatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgggaagcggagagggcagaggaagtctgctaacatgcggtgacgtcgaggagaatcctggacctatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaataactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgactcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccg

SEQ ID NO: 217 - DNA, 30361 bp, synthetic construct
  misc_feature 1..30361: note = 17M2
  source 1..30361: mol_type = other DNA
cggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgaggcacacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcaccccgcacccggcgctcacccgtcccagccccgccgcccgcagccccagctgcaacgcagccaccgccgccatcgcacccggccccgcgggcgcttccgggacgcaggaagcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaagggggcgcggcaggagggggcaccagggagcggagccctggccctcctgacgtcctgcccgcccacgcgtccgcaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgtaggtggtcctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactactataccatatctttccagaaatatgaaggcttgtgaaagataagcaagcctatgatggccactgtgaaaaggaccagggagaatagaaccatgaggaagacataggtggagtgggagagaggtgtggacaatggttgctcagctgggatcatgttggtcaggttcagcatgtagcccaaagtccagccggcgtcgctgccctggatcttgccaatgaaatggatgtgctcccaggaatcagctgtgaaatgatagccttgcagaaggagggagagaatgtaggtaccagaaaagcagtattcactcaggtacttctcctttactccagcgtaagatgtttttatctcctcccaaggctgagcacagaactttttcatcatctcagtcaccttttcctgagagactttctctgatgtcaagtttaaaaacttcatcacaaagtaaaaagctgaaaatgccccaaaatccccctggagtggtggcaagaaaatcccattgaaggcacactgggagtaagggcagtaactggtgttgaagagctccaggatgctttgatggcattgttgatagtttccaataccctggatttcaaactgctggaatggaagagtcatctcaaatctcttggtgcagggggtcttgtaaaggtcacttacgttcactaccttcttatatccaggatgaaagcatgggtccctgagaatttcattacttgcaacctgaatgtccttggccagtttctgccagagtgcctgatccttcccatagcacaagaagctatgtgtgtagacattgtagtccttgccatagaggcgaaattgcagagcattatctggggactcgatagtctggttttggggtacaaaagtgacttgtgtagaggctcccccaaggtccaaagctccaaaggtttcctgattattggtttcatatgggactatgctgaaccaccttgttttctgactgaatttgcccagcagatagttgatagtaatccagccataggcaccttcctcttggccagtaatgatcctggcaccctggaagtcaaaggggtagttgctgaggctcctctccaccacatccagaaccctgtctgccaactcttcactttccatcctgagcaaccgcatgcctgccgtggctcccaggtaaacgggtgtctcttggtgctgggaccttggaatcacttccctagctctttccatgcaatcagtcaggtaaatgcctatttcatttactttctgaacaaattttgagattccaggacctttaaccctgcattcttctacttgatgcaccacgcctgtgtcattctccttttctgctggccacttatagatgtataaacttgtgtgagaagaacccgcatccagcacaatcccatacttaacgttttctggcaatgctttgttctgggtcaaccccacagcaagcaaagctatcacagctatgatagaggagaagccaaggatggctaggatattcttggagcaaaatgtcttcacgttagactcctttgtatcttccataggtccagggttgctctcaacatctccagccaatttcaagagagcataattagtacactgtccgcttccgagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagctgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaaccccaggccggccagggccagcgcgccaaggaccaggaccccaagcataggcccaggattctcctccacgtcgccagcctgctttaacaggctaaaattggtggcgccactgccaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcggttgctgaaaaaaagaaaaatctggtttaaaaattcaattaatcaaaatatttccctcatcccttaacagaacacttaaccaggaaaaacgtatggccactgccaagaggtaatagtgcccatcacctcctgtctaagcacgcgcgaggtccagaactagtgctgcagtccaggttgccgtgccaaccgcagcagagcacgccctagatgaaggacccatctacccagacggcgtggggcgttgctcaacacgtggtcttaccccgaactgagcactgtctgttcccctccctcgccaggtgccagtgcccccgggagtcaacgggcttttaactactccggaatgtacccccatactggaagcacgccaagaacagctctgaagaaccacggtgggactggactaagcagggaactgggtgaaagaaaacgctggctccacttccccgcgcgccaggcaaaccgatgcagcaaccctcccccgccacgcggccgccgggcgtctcccagcctcccctggggccactgcggcccactccctacatttccgtcctgccggctgcaaccaaataccgctgccatcccaccgaaaactgaggccctttaagccggtagaaggagccgcacactcgcctcgacgagattctcagaacccccaagcctcagcaagcccaacaggcctgtgtggaggctgcacgctcccagacccacaacccaactcttgagcagaggttttacctggggtgtaggcctggctccaataacgaaggaagccacaaaaaacccaagagctgcaggcgagttcaatgagaccggtttccgcccgccaccctgcctcttataccctatcttagaaccttccagaaggggcccgcccctgctgcctgccattacggcttccccggccaatagacgcccggctgcccttacaagacccaatcacaagcccggctccactcctcgggcctcgcccccttccgcacccaccccaccgcgctccgcctcacgataacgcactcaccgcagcgttctggaactttcaagctcgcccccgctctccggacggccccggggaaagggagggtggggcgcagcgagtccgcgcgcgggagtcctcagttaccccgggcgggggaggggagcgtccacctctacgcatgcgcccccagcttccgcgggagggagggggcggaaaaaggaggaggaagaggggcgggcaaacttggaactaaccaatgatagcggcgctagccgggatcttggccggcacagaactgggggcggaatcgcgcggggcctgaagggaggggtttgggcgcgggagccgggccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctcccccacggaggcggctggccgacttccactgaggcgccaacggcctcgccatgcccttttcaataactcattgatttcaaacccgttacgtctatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgactggcagtggagccaccaacttctcactccttaagcaggctggcgacgtggaggagaaccccgggcctatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctgatagcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgattatatggccacaaccatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggcggcagcggcgccaccaatttctcactactgaaacaggccggtgacgtcgaggagaaccccgggcctatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgggaagcggagagggcagaggaagtctgctaacatgcggtgacgtcgaggagaatcctggacctatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaataactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgactcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccg

SEQ ID NO: 218 - DNA, 23335 bp, synthetic construct
  misc_feature 1..23335: note = 17P
  source 1..23335: mol_type = other DNA
cggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgaggcacacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcaccccgcacccggcgctcacccgtcccagccccgccgcccgcagccccagctgcaacgcagccaccgccgccatcgcacccggccccgcgggcgcttccgggacgcaggaagcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaagggggcgcggcaggagggggcaccagggagcggagccctggccctcctgacgtcctgcccgcccacgcgtccgcaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgtaggtggtcctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgttatggctccgcggactttaattttaggttgcggcgcttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactatcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagctgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaaccccaggccggccagggccagcgcgccaaggaccaggaccccaagcataggtccagggttgctctcaacatctccagccaatttcaagagagcataattagtacactgtccgcttccaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcggttgctgaaaaaaagaaaaatctggtttaaaaattcaattaatcaaaatatttccctcatcccttaacagaacacttaaccaggaaaaacgtatggccactgccaagaggtaatagtgcccatcacctcctgtctaagcacgcgcgaggtccagaactagtgctgcagtccaggttgccgtgccaaccgcagcagagcacgccctagatgaaggacccatctacccagacggcgtggggcgttgctcaacacgtggtcttaccccgaactgagcactgtctgttcccctccctcgccaggtgccagtgcccccgggagtcaacgggcttttaactactccggaatgtacccccatactggaagcacgccaagaacagctctgaagaaccacggtgggactggactaagcagggaactgggtgaaagaaaacgctggctccacttccccgcgcgccaggcaaaccgatgcagcaaccctcccccgccacgcggccgccgggcgtctcccagcctcccctggggccactgcggcccactccctacatttccgtcctgccggctgcaaccaaataccgctgccatcccaccgaaaactgaggccctttaagccggtagaaggagccgcacactcgcctcgacgagattctcagaacccccaagcctcagcaagcccaacaggcctgtgtggaggctgcacgctcccagacccacaacccaactcttgagcagaggttttacctggggtgtaggcctggctccaataacgaaggaagccacaaaaaacccaagagctgcaggcgagttcaatgagaccggtttccgcccgccaccctgcctcttataccctatcttagaaccttccagaaggggcccgcccctgctgcctgccattacggcttccccggccaatagacgcccggctgcccttacaagacccaatcacaagcccggctccactcctcgggcctcgcccccttccgcacccaccccaccgcgctccgcctcacgataacgcactcaccgcagcgttctggaactttcaagctcgcccccgctctccggacggccccggggaaagggagggtggggcgcagcgagtccgcgcgcgggagtcctcagttaccccgggcgggggaggggagcgtccacctctacgcatgcgcccccagcttccgcgggagggagggggcggaaaaaggaggaggaagaggggcgggcaaacttggaactaaccaatgatagcggcgctagccgggatcttggccggcacagaactgggggcggaatcgcgcggggcctgaagggaggggtttgggcgcgggagccgggccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctcccccacggaggcggctggccgacttccactgaggcgccaacggcctcgccatgcccttttcaataactcattgatttcaaacccgttacgtctatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcacttcatctgcaacgagggttactacctgattggtgaggagatcctgtattgtgaacttaaaggatcagtagcaatttggagcggtaagcccccaatatgtgagaaggtcttgtgtacaccacctccaaagatcaagaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagtaaaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacggagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccg

SEQ ID NO: 219 - DNA, 27358 bp, synthetic construct
  misc_feature 1..27358: note = 17S1
  source 1..27358: mol_type = other DNA
cggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgaggcacacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcaccccgcacccggcgctcacccgtcccagccccgccgcccgcagccccagctgcaacgcagccaccgccgccatcgcacccggccccgcgggcgcttccgggacgcaggaagcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaagggggcgcggcaggagggggcaccagggagcggagccctggccctcctgacgtcctgcccgcccacgcgtccgcaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgtaggtggtcctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactatcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagctgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaaccccaggccggccagggccagcgcgccaaggaccaggaccccaagcataggcccaggattctcctccacgtcgccagcctgctttaacaggctaaaattggtggcgccactgccaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcggttgctgaaaaaaagaaaaatctggtttaaaaattcaattaatcaaaatatttccctcatcccttaacagaacacttaaccaggaaaaacgtatggccactgccaagaggtaatagtgcccatcacctcctgtctaagcacgcgcgaggtccagaactagtgctgcagtccaggttgccgtgccaaccgcagcagagcacgccctagatgaaggacccatctacccagacggcgtggggcgttgctcaacacgtggtcttaccccgaactgagcactgtctgttcccctccctcgccaggtgccagtgcccccgggagtcaacgggcttttaactactccggaatgtacccccatactggaagcacgccaagaacagctctgaagaaccacggtgggactggactaagcagggaactgggtgaaagaaaacgctggctccacttccccgcgcgccaggcaaaccgatgcagcaaccctcccccgccacgcggccgccgggcgtctcccagcctcccctggggccactgcggcccactccctacatttccgtcctgccggctgcaaccaaataccgctgccatcccaccgaaaactgaggccctttaagccggtagaaggagccgcacactcgcctcgacgagattctcagaacccccaagcctcagcaagcccaacaggcctgtgtggaggctgcacgctcccagacccacaacccaactcttgagcagaggttttacctggggtgtaggcctggctccaataacgaaggaagccacaaaaaacccaagagctgcaggcgagttcaatgagaccggtttccgcccgccaccctgcctcttataccctatcttagaaccttccagaaggggcccgcccctgctgcctgccattacggcttccccggccaatagacgcccggctgcccttacaagacccaatcacaagcccggctccactcctcgggcctcgcccccttccgcacccaccccaccgcgctccgcctcacgataacgcactcaccgcagcgttctggaactttcaagctcgcccccgctctccggacggccccggggaaagggagggtggggcgcagcgagtccgcgcgcgggagtcctcagttaccccgggcgggggaggggagcgtccacctctacgcatgcgcccccagcttccgcgggagggagggggcggaaaaaggaggaggaagaggggcgggcaaacttggaactaaccaatgatagcggcgctagccgggatcttggccggcacagaactgggggcggaatcgcgcggggcctgaagggaggggtttgggcgcgggagccgggccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctcccccacggaggcggctggccgacttccactgaggcgccaacggcctcgccatgcccttttcaataactcattgatttcaaacccgttacgtctatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagtagcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgattatatggccacaaccatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggcggcagcggcgccaccaatttctcactactgaaacaggccggtgacgtcgaggagaaccccgggcctatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgtgataactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgactcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccg

SEQ ID NO: 220 - DNA, 27379 bp, synthetic construct
  misc_feature 1..27379: note = 17S2
  source 1..27379: mol_type = other DNA
cggggacagccccccccaaagcccccagggatgtaattgcgtccctctcccgctagggggcagcagcgagccgcccggggctccgctccggcccgacgcttccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccaacagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcccatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcattcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgaggcacacgaccacaattccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcctgcggacacggacgggcgggctgagctccgggacccctccccgcgccccgcaccccgcaccccgcaccccgcacccggcgctcacccgtcccagccccgccgcccgcagccccagctgcaacgcagccaccgccgccatcgcacccggccccgcgggcgcttccgggacgcaggaagcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggttcgcagcgcgggaggggaacggagtggcggagaagggcgcagttgggatgaggggctgaggggagggcaggggagaggagagggcaggggagaggggagaggggagagcaggagagaggggagggcaggggagagggcgcggcgggatcaggggaggagagggaagggggcgcggcaggagggggcaccagggagcggagccctggccctcctgacgtcctgcccgcccacgcgtccgcaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgtaggtggtcctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactatcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagctgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaaccccaggccggccagggccagcgcgccaaggaccaggaccccaagcataggcccaggattctcctccacgtcgccagcctgctttaacaggctaaaattggtggcgccactgccaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcggttgctgaaaaaaagaaaaatctggtttaaaaattcaattaatcaaaatatttccctcatcccttaacagaacacttaaccaggaaaaacgtatggccactgccaagaggtaatagtgcccatcacctcctgtctaagcacgcgcgaggtccagaactagtgctgcagtccaggttgccgtgccaaccgcagcagagcacgccctagatgaaggacccatctacccagacggcgtggggcgttgctcaacacgtggtcttaccccgaactgagcactgtctgttcccctccctcgccaggtgccagtgcccccgggagtcaacgggcttttaactactccggaatgtacccccatactggaagcacgccaagaacagctctgaagaaccacggtgggactggactaagcagggaactgggtgaaagaaaacgctggctccacttccccgcgcgccaggcaaaccgatgcagcaaccctcccccgccacgcggccgccgggcgtctcccagcctcccctggggccactgcggcccactccctacatttccgtcctgccggctgcaaccaaataccgctgccatcccaccgaaaactgaggccctttaagccggtagaaggagccgcacactcgcctcgacgagattctcagaacccccaagcctcagcaagcccaacaggcctgtgtggaggctgcacgctcccagacccacaacccaactcttgagcagaggttttacctggggtgtaggcctggctccaataacgaaggaagccacaaaaaacccaagagctgcaggcgagttcaatgagaccggtttccgcccgccaccctgcctcttataccctatcttagaaccttccagaaggggcccgcccctgctgcctgccattacggcttccccggccaatagacgcccggctgcccttacaagacccaatcacaagcccggctccactcctcgggcctcgcccccttccgcacccaccccaccgcgctccgcctcacgataacgcactcaccgcagcgttctggaactttcaagctcgcccccgctctccggacggccccggggaaagggagggtggggcgcagcgagtccgcgcgcgggagtcctcagttaccccgggcgggggaggggagcgtccacctctacgcatgcgcccccagcttccgcgggagggagggggcggaaaaaggaggaggaagaggggcgggcaaacttggaactaaccaatgatagcggcgctagccgggatcttggccggcacagaactgggggcggaatcgcgcggggcctgaagggaggggtttgggcgcgggagccgggccgaggagacaccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctcccccacggaggcggctggccgacttccactgaggcgccaacggcctcgccatgcccttttcaataactcattgatttcaaacccgttacgtctatcgcggactcagtcgcttcagcccgatttcccgcagccgagcgagatgagagagatcgatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccggcccctgccttggcgaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcgggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgccggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagtagcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgattatatggccacaaccatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggcggcagcggcgccaccaatttctcactactgaaacaggccggtgacgtcgaggagaaccccgggcctatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgtgataactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgactcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgataggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgctggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggagcgtcgggccggagcggagccccgggcggctcgctgctgccccctagcgggagagggacgcaattacatccctgggggctttggggggggggctgtccccg

SEQ ID NO: 221 - DNA, 26154 bp, synthetic construct
  misc_feature 1..26154: note = 18S1
  source 1..26154: mol_type = other DNA
agttaggggctattgcaattatccagcaagagatcttggaccaggatggcagcagtggaggtggtaaaatgtggttggatgaagcgtacgctttgaaggtatcaacaggaccagctgatggaagggagtcaacaggactagctgatggctgtaaactggggggtcactagctatcagatggcatttacttaaagccatggaagtaggtgagctcccttatggagagggaataggaaggaggtagaccattctatcaaaatgctctttctacagggcacttctcactgagatattatttatctgggatttatattatttattcaatttgttttgtgtttggttctattagaaaagctccataggggccgggcacgttggcttttgcctgtaatcccaacactttggaaggccgaggcaggcggattacctggggtcaggagtttgataccagcctggccaacatggtgaaactctgtctctactaaaaacacaaaaattagccgggcgtggtggtgcgcctgtaatcccagatgctgaggaggagaatcgcttgaacccgggaggtggaggttgcagtgagccgagatcgcgccactgcactccagcctgggcaacaagagcgaaactccctctcaaaaacaaacaaacaaacaaacaaacaaacaaaaaacaaaaaaaagaaagaaagaaagaaaagggccaggtgtggtggctcacacctgtaatcccagcactttgggaggctgaggcaggcggatcacgaggtcaggagatcgataccatcctcaccaacacggtgaaaccctgtctctactaaaaatacaaaaattagtcgggtgtggtggcgggcgcctgtagtcccaggtactccgcaggctgaggcaggagaatcgcttgaacccgggaggcggaggttgtagtgagccgagattgagccactgcactccagcctgggtgacaaagtgagactccatctcaaaagaaaaaagctccataggagaaggaaccttgtctcttcaccacataaactgtgtttggattcgcaatcgagttgggaaaaaaaaatcagtctggaagagccacaccaaaccgctaacagctactgtctctgggaatagaacaaggagtttggttggcgcgatataccgcccctgaacctctagccacaataaggcttaattaatgaccggacgacttgaaagcgccttccactgtttatctcttaaatctgcaacgaaatgcaacaaaaacgcaagaaataaacaatagaagcctcaagagaaatgttctggcacctgcacttgcactggggacagcctattttgctagtttgttttgtttcgttttgttttgatggagagcgtatgttagtactatcgattcacacaaaaaaccaacacacagatgtaatgaaaataaagatattttatttcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcataggtccagggttgctctcaacatctccagccaatttcaagagagcataattagtacactgtccgcttccacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcaagaataggtggtgccaagatcaatgccaactgcaggtcccttagacatggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatgctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactactataccatatctttccagaaatatgaaggcttgtgaaagataagcaagcctatgatggccactgtgaaaaggaccagggagaatagaaccatgaggaagacataggtggagtgggagagaggtgtggacaatggttgctcagctgggatcatgttggtcaggttcagcatgtagcccaaagtccagccggcgtcgctgccctggatcttgccaatgaaatggatgtgctcccaggaatcagctgtgaaatgatagccttgcagaaggagggagagaatgtaggtaccagaaaagcagtattcactcaggtacttctcctttactccagcgtaagatgtttttatctcctcccaaggctgagcacagaactttttcatcatctcagtcaccttttcctgagagactttctctgatgtcaagtttaaaaacttcatcacaaagtaaaaagctgaaaatgccccaaaatccccctggagtggtggcaagaaaatcccattgaaggcacactgggagtaagggcagtaactggtgttgaagagctccaggatgctttgatggcattgttgatagtttccaataccctggatttcaaactgctggaatggaagagtcatctcaaatctcttggtgcagggggtcttgtaaaggtcacttacgttcactaccttcttatatccaggatgaaagcatgggtccctgagaatttcattacttgcaacctgaatgtccttggccagtttctgccagagtgcctgatccttcccatagcacaagaagctatgtgtgtagacattgtagtccttgccatagaggcgaaattgcagagcattatctggggactcgatagtctggttttggggtacaaaagtgacttgtgtagaggctcccccaaggtccaaagctccaaaggtttcctgattattggtttcatatgggactatgctgaaccaccttgttttctgactgaatttgcccagcagatagttgatagtaatccagccataggcaccttcctcttggccagtaatgatcctggcaccctggaagtcaaaggggtagttgctgaggctcctctccaccacatccagaaccctgtctgccaactcttcactttccatcctgagcaaccgcatgcctgccgtggctcccaggtaaacgggtgtctcttggtgctgggaccttggaatcacttccctagctctttccatgcaatcagtcaggtaaatgcctatttcatttactttctgaacaaattttgagattccaggacctttaaccctgcattcttctacttgatgcaccacgcctgtgtcattctccttttctgctggccacttatagatgtataaacttgtgtgagaagaacccgcatccagcacaatcccatacttaacgttttctggcaatgctttgttctgggtcaaccccacagcaagcaaagctatcacagctatgatagaggagaagccaaggatggctaggatattcttggagcaaaatgtcttcacgttagactcctttgtatcttccataggcccaggattctcctccacgtcgccagcctgctttaacaggctaaaattggtggcgccactgccattgatgggaataaaataaggctgaaattgcttttcacattctggctctgttgggggcattttcacatagacccctgttgtaagagggcttcttttctttagcattttgctcaaagaaacagctgtgaggagaaagctataaaaaaacaaccccgaactaactgctgcaaggatccagaggaggaagtcagaatctgggcacggttctggatcaattacataaatctgggttccgttgcctatgcccaggtagtatggcggtgggtacatgagctccaccttgcagatgtagagtcccgtgtccatggccctcagtccttggatagtgaggttcacttgatttccactggaggtgcccgtgcagatggaatcatctaggaaggtcaactcattccccatcatgtaggttgccgcacagacttcagtcacctggctgtcagcctgccgaagcactgtcacccggacctcagtggctttgcctggagatgcatactcacacacaaagctggcgatgcctcggctgctggccagtaccacagcaggctgggccacgtgcattgctttgcagaagacagggatgaagagaagaaaaaacaggagagtgcagggccaggtcctggtagccaggttcagctgagccttgtgccgctgaaatccaaggcaagccatggtggctttcccatttttgcttagcttttagcgatggctttcacgacacctaagacgacaaaaaccttctttaaactactgtcccgacgaccggagactcaggcacaaccccaacagccaagggcaaactccagggagcattagcaccggcgccctgcgggccctgcccggcctacacccagcgaacggggccgccccggcgcccagcccctcccccacccgggccgcgagtcccgggaagcggcgcgggcagcaccgcccggccctttgtgcgccgcccgccgtccgcgtcctccatcttgagaccgggagcggccatctttccgcgctcgcagcccgcccgggcggggcgctgggtctccgaccgcccgccccgccccgccgcggccgtctgccccgggaccgccgggcacggaggccaccttgggcggcctcggctgggccgccctggcagtaacacgcggctgccggccgaactcgagcgcgaagacagacggggcgggcgcgaaggcgcggatcgcacgcggcggccacggcgccccagcaggccgccaccgggcacgcggtagggaaccgcgagagcggagggcctcgagttctccacctccccccgcccgcagctcggaatcaggaccagggcgcagagccctctacgcgcggggggccgggaggcacgctaaggccgtggccaccggcggaggccatgcggacggaggccacacccgtactcacctgtgtcctggcggcaaacccgttgcgaaaaagaacgttcgcggggaccacggcgcttatatatggtcctcccccaccctcggggaaaagggcggagccagcacacgacaccactttcccagtttaccccgcgccacctccacccggcaccggttccaccgccgtcccctccccccatcttcggggaccgtgggcgatgtgcgttcagcccactgacgagcacacggcgcccggcgcatgctcctctcaaccaggaggatgacgactgctggtgggtgggaggcggggtcgagcgctcactcggttctaggtttagtgggagtttatcgacggtccctgggatttccctggctgaggagagtcctccttttgtatgaattactctccgcacagctggggggtggggcggcggggaggcgtccagaatcttccctgaaccggtcgtagcttaactgcaaagttggaccgagatgggagcccttacccggcagtaccccaccggtcctcagtcttgcggtctcgcaggttaaggactaacccctggagccgcttcctctgccggggcttctccaccgcccttgccgtccgcgccccttccggctggagagggaggcgtaaaaggccggggaaccgcggcggcaggggcctcggggcggtcttcagggccgagaatccgcgagtggctcagtttgctgaccaacagcctggcgaacaggctcctgcgctgacctcttggctttttccattcagttcttttatctaagttcgttctacacaccacgtggtactccagacgtccagtttttgagtttagaatagacttaagtactacagttttctttacttctaatcctaattttattacgtttaagaccctgagtgtgtgtctaccctcctattaacattttttttccagtgtatactcttggttgcaagcatgaaaaacctaaaaagaattttttgagttcagtgcttatacacgatctcaagtagagactaagatctacagcgccaggaagcttatccacccaatttactactccaacgtttgctgtgaaatcactgtttctcaaaaatggcctatcccatttgaataaacggcttcatcttttgtcgtcctatccattgtgactgcattttaggcataaatccagggcaagacaagatgaggcctttttggttggcaatcaggcagatattcaaaaatattcctgaagaaagaggaacctttattttaaatgagctaattactagatcgtctcttccacgtgtagagcactactgcaactttttgagccaatctatcaacaaatatttgagaacctactatgtggccagagctaagagtggctccgaagcatatgcaaaagaaatacttcctttgggggaagaaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttaactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctga

SEQ ID NO: 222 - DNA, 27195 bp, synthetic construct
  misc_feature 1..27195: note = 18S2
  source 1..27195: mol_type = other DNA
agttaggggctattgcaattatccagcaagagatcttggaccaggatggcagcagtggaggtggtaaaatgtggttggatgaagcgtacgctttgaaggtatcaacaggaccagctgatggaagggagtcaacaggactagctgatggctgtaaactggggggtcactagctatcagatggcatttacttaaagccatggaagtaggtgagctcccttatggagagggaataggaaggaggtagaccattctatcaaaatgctctttctacagggcacttctcactgagatattatttatctgggatttatattatttattcaatttgttttgtgtttggttctattagaaaagctccataggggccgggcacgttggcttttgcctgtaatcccaacactttggaaggccgaggcaggcggattacctggggtcaggagtttgataccagcctggccaacatggtgaaactctgtctctactaaaaacacaaaaattagccgggcgtggtggtgcgcctgtaatcccagatgctgaggaggagaatcgcttgaacccgggaggtggaggttgcagtgagccgagatcgcgccactgcactccagcctgggcaacaagagcgaaactccctctcaaaaacaaacaaacaaacaaacaaacaaacaaaaaacaaaaaaaagaaagaaagaaagaaaagggccaggtgtggtggctcacacctgtaatcccagcactttgggaggctgaggcaggcggatcacgaggtcaggagatcgataccatcctcaccaacacggtgaaaccctgtctctactaaaaatacaaaaattagtcgggtgtggtggcgggcgcctgtagtcccaggtactccgcaggctgaggcaggagaatcgcttgaacccgggaggcggaggttgtagtgagccgagattgagccactgcactccagcctgggtgacaaagtgagactccatctcaaaagaaaaaagctccataggagaaggaaccttgtctcttcaccacataaactgtgtttggattcgcaatcgagttgggaaaaaaaaatcagtctggaagagccacaccaaaccgctaacagctactgtctctgggaatagaacaaggagtttggttggcgcgatataccgcccctgaacctctagccacaataaggcttaattaatgaccggacgacttgaaagcgccttccactgtttatctcttaaatctgcaacgaaatgcaacaaaaacgcaagaaataaacaatagaagcctcaagagaaatgttctggcacctgcacttgcactggggacagcctattttgctagtttgttttgtttcgttttgttttgatggagagcgtatgttagtactatcgattcacacaaaaaaccaacacacagatgtaatgaaaataaagatattttatttcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcataggtccagggttgctctcaacatctccagccaatttcaagagagcataattagtacactgtccgcttccacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcaagaataggtggtgccaagatcaatgccaactgcaggtcccttagacatggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatgctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattacgtctcctccaaatgtgtatcactttgcttctttgagtttgtatcttggatgccacattttttcacatccatcattctcccttttcttaaacggaagatgaatgtcagtgctacaccaaggcataataagatggctcccagaattaccaagtgagtcctttcatttggaggatgtgccagaggtagttctgggatgaccaattcagctgtatggttttcctcaggatctaatctcctaaaagtgcagtagaaaatctcattagttgttgtgttgattctcagtgtgctggtcacattgaaaagcttctcctctctcttggaattggtggtggtggtcttaccactcaggacttgatggtcactgcttgtccagatgacttcggccttggggtagccctcagcctgacatgtcagttcatgttcagaggtgactggatccacaaccaaaattctttggttgattttgttgtatggggcattgactttcacagtaattcgcttgtagtcggcaccaccatagctgatcatgcagcggtacacccctgcatcctgcaatttcacatctgtgatctgaagtgcagcatttcccagggagagctggtccttcaacagccgggccctctgtctgtagctactatgctgaaccttcaggtcttcctctccatgcacaaattgaataatgttcttatcctccatttcccaatagacaattagtgcagccaggtctaattgtttttctactgggaatttgcattcaattgtcatattgctaccatactctaccacatataggtccttgggaaccgtgacagtaaatgcgttcagcaaatgccagtaggtcatgaatataaagacagcaaatatcctcataggcccaggattctcctccacgtcgccagcctgctttaacaggctaaaattggtggcgccactgccgccatacatctgcttgaactgaaagcattcgttgcagtagccgttgcacttggcattgccaaaatgatcacaggcgggggcccggcaacgctgcttgggggggtcttcgggggcaggctcaccccggtgggccccagggcccatcctctggttgggatgctgacactccatgcagagctcctcgctgcggcaggccaggatgttcttgcaggaggcccgggcgcacttgggccttgaggtgctttgtgtggttcgaggcacatctctgcgctggctcgatctcagttgctcttctgtccttttggcctcatgaaatctctgattctgagcttcaatgaaacacttctggcagtatccttcaaacatggtgcttccaagggtgccgcattccctccccaggcacggaatggtgttctggaacctggacgctgtgggactgactttccctgaggcagcagcaaaatgtttgttttctctgtactcgatgaaacacagtgtgcaaaagcccttgttttctggagtcccaaaatacacgcagccggcttttctgcacttgctcgtccccgtcctgtccccaggagtccgtgcagcttgagacaggcagccagcaggggcgtcgtttccagctctgtggcaagaatgcggggaggggctccggacgagccgcgagggatctgacttggaacgctggtgacaggaaggagggaggctggtgctgaggctggaggaggcctctgctgtagtccttttgaagcaagtactgcagatcccattaaatgtcctggtaacatcctggaggcaggcttggcacttcccgggatccaagtgccttgtgtggtctggggcgtggctggcgtgaagttgccgggcgttgtggcaacgttcacaaaatccgttgtgctgcacattcagtgtgaaggggcagccggggctcctgcacttcatggcagtggtctcactgaacagaaaagggctgggtgctgtcggtggggccgaatgaggccccccagtggactcctcagggttccacgccaagggctcataggcttctccccgagaggccccgagcgccatgccagggagcccctcagggcccggcttggagttcagctttgggagtttgttttgattcttttgccgcctctctgagcactcatggcataaaggctgggtgttcacagacatgaagaaggggcagttgggcgtttcacattttacatccatgagagaaagctggggcacggaaggttccatgggattctgggcgtgcccctctctcctcccctgctcgctgttttcctgccatttcttgtactcatgctgaacaagttcaaagtaatcatctaccagattgatttcttttggtaagttagcttcatccaactttgcggcattgatgagatgagttgtgccatggtcccagccttggacggggatttctatcaccattaagtactcttttaagagcttctccttcatctcattttcaggatctgtcaaaaagtgaacttttaagtcttcaaatcttccccggtctctgttaacaagtggaacagctcggatttcaggcccactgtccttcagggtcaccaagggtacaaaatgatggctgtcatagccgagaacaatggggtatctgtagcattcctgggcaggccagtggagaggcaagtaaattccacccactttcaaaggggcgaaattggaacctgattccaaacttcttagcattttgtctgaaatgacaatgattggccttctgaggatgttgcaaaggacaaatatgtgtatttcttccagtgagttgtactgaagtccacttcgggccatgggtgtgtctgtggaagccattttgataagattgtcccattcatcattccagttccgagtatcatagcaaagccccgtttcaacaaattcctgagatttgagagactccagttgccagcggaatttaaagttgcgtgtgtctgtttccttgagcgtgctgaacagcgccttcctcagtaccaagtctgtgtcctgaacgccccacatgtactgagaagtggcatgcatgaggcaattgccgtcaccgttcgttttcagcgccacaagcttccggacttctcgacaccagttgagtttcttctggctttccagggtggcctggatgtttctgtcgatgagggctttgtggatgatctcccgaaactgaggacaaaactggcaagttctgaacatttccagtgtgtatcggtgcatggttttaaaatgatgaatgatcccattagtaggtttaaaaatgtcttctggagttctctcccgtatcttcacagctttccgcatattgctcaaatacaaagcctgaggaaggacttgttcagccatggtggctttcccatttttgcttagcttttagcgatggctttcacgacacctaagacgacaaaaaccttctttaaactactgtcccgacgaccggagactcaggcacaaccccaacagccaagggcaaactccagggagcattagcaccggcgccctgcgggccctgcccggcctacacccagcgaacggggccgccccggcgcccagcccctcccccacccgggccgcgagtcccgggaagcggcgcgggcagcaccgcccggccctttgtgcgccgcccgccgtccgcgtcctccatcttgagaccgggagcggccatctttccgcgctcgcagcccgcccgggcggggcgctgggtctccgaccgcccgccccgccccgccgcggccgtctgccccgggaccgccgggcacggaggccaccttgggcggcctcggctgggccgccctggcagtaacacgcggctgccggccgaactcgagcgcgaagacagacggggcgggcgcgaaggcgcggatcgcacgcggcggccacggcgccccagcaggccgccaccgggcacgcggtagggaaccgcgagagcggagggcctcgagttctccacctccccccgcccgcagctcggaatcaggaccagggcgcagagccctctacgcgcggggggccgggaggcacgctaaggccgtggccaccggcggaggccatgcggacggaggccacacccgtactcacctgtgtcctggcggcaaacccgttgcgaaaaagaacgttcgcggggaccacggcgcttatatatggtcctcccccaccctcggggaaaagggcggagccagcacacgacaccactttcccagtttaccccgcgccacctccacccggcaccggttccaccgccgtcccctccccccatcttcggggaccgtgggcgatgtgcgttcagcccactgacgagcacacggcgcccggcgcatgctcctctcaaccaggaggatgacgactgctggtgggtgggaggcggggtcgagcgctcactcggttctaggtttagtgggagtttatcgacggtccctgggatttccctggctgaggagagtcctccttttgtatgaattactctccgcacagctggggggtggggcggcggggaggcgtccagaatcttccctgaaccggtcgtagcttaactgcaaagttggaccgagatgggagcccttacccggcagtaccccaccggtcctcagtcttgcggtctcgcaggttaaggactaacccctggagccgcttcctctgccggggcttctccaccgcccttgccgtccgcgccccttccggctggagagggaggcgtaaaaggccggggaaccgcggcggcaggggcctcggggcggtcttcagggccgagaatccgcgagtggctcagtttgctgaccaacagcctggcgaacaggctcctgcgctgacctcttggctttttccattcagttcttttatctaagttcgttctacacaccacgtggtactccagacgtccagtttttgagtttagaatagacttaagtactacagttttctttacttctaatcctaattttattacgtttaagaccctgagtgtgtgtctaccctcctattaacattttttttccagtgtatactcttggttgcaagcatgaaaaacctaaaaagaattttttgagttcagtgcttatacacgatctcaagtagagactaagatctacagcgccaggaagcttatccacccaatttactactccaacgtttgctgtgaaatcactgtttctcaaaaatggcctatcccatttgaataaacggcttcatcttttgtcgtcctatccattgtgactgcattttaggcataaatccagggcaagacaagatgaggcctttttggttggcaatcaggcagatattcaaaaatattcctgaagaaagaggaacctttattttaaatgagctaattactagatcgtctcttccacgtgtagagcactactgcaactttttgagccaatctatcaacaaatatttgagaacctactatgtggccagagctaagagtggctccgaagcatatgcaaaagaaatacttcctttgggggaagaaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttaactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctga

SEQ ID NO: 223 - DNA, 26976 bp, synthetic construct
  misc_feature 1..26976: note = 18S3
  source 1..26976: mol_type = other DNA
agttaggggctattgcaattatccagcaagagatcttggaccaggatggcagcagtggaggtggtaaaatgtggttggatgaagcgtacgctttgaaggtatcaacaggaccagctgatggaagggagtcaacaggactagctgatggctgtaaactggggggtcactagctatcagatggcatttacttaaagccatggaagtaggtgagctcccttatggagagggaataggaaggaggtagaccattctatcaaaatgctctttctacagggcacttctcactgagatattatttatctgggatttatattatttattcaatttgttttgtgtttggttctattagaaaagctccataggggccgggcacgttggcttttgcctgtaatcccaacactttggaaggccgaggcaggcggattacctggggtcaggagtttgataccagcctggccaacatggtgaaactctgtctctactaaaaacacaaaaattagccgggcgtggtggtgcgcctgtaatcccagatgctgaggaggagaatcgcttgaacccgggaggtggaggttgcagtgagccgagatcgcgccactgcactccagcctgggcaacaagagcgaaactccctctcaaaaacaaacaaacaaacaaacaaacaaacaaaaaacaaaaaaaagaaagaaagaaagaaaagggccaggtgtggtggctcacacctgtaatcccagcactttgggaggctgaggcaggcggatcacgaggtcaggagatcgataccatcctcaccaacacggtgaaaccctgtctctactaaaaatacaaaaattagtcgggtgtggtggcgggcgcctgtagtcccaggtactccgcaggctgaggcaggagaatcgcttgaacccgggaggcggaggttgtagtgagccgagattgagccactgcactccagcctgggtgacaaagtgagactccatctcaaaagaaaaaagctccataggagaaggaaccttgtctcttcaccacataaactgtgtttggattcgcaatcgagttgggaaaaaaaaatcagtctggaagagccacaccaaaccgctaacagctactgtctctgggaatagaacaaggagtttggttggcgcgatataccgcccctgaacctctagccacaataaggcttaattaatgaccggacgacttgaaagcgccttccactgtttatctcttaaatctgcaacgaaatgcaacaaaaacgcaagaaataaacaatagaagcctcaagagaaatgttctggcacctgcacttgcactggggacagcctattttgctagtttgttttgtttcgttttgttttgatggagagcgtatgttagtactatcgattcacacaaaaaaccaacacacagatgtaatgaaaataaagatattttatttcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcataggtccagggttgctctcaacatctccagccaatttcaagagagcataattagtacactgtccgcttccacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcaagaataggtggtgccaagatcaatgccaactgcaggtcccttagacatggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatgctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactactataccatatctttccagaaatatgaaggcttgtgaaagataagcaagcctatgatggccactgtgaaaaggaccagggagaatagaaccatgaggaagacataggtggagtgggagagaggtgtggacaatggttgctcagctgggatcatgttggtcaggttcagcatgtagcccaaagtccagccggcgtcgctgccctggatcttgccaatgaaatggatgtgctcccaggaatcagctgtgaaatgatagccttgcagaaggagggagagaatgtaggtaccagaaaagcagtattcactcaggtacttctcctttactccagcgtaagatgtttttatctcctcccaaggctgagcacagaactttttcatcatctcagtcaccttttcctgagagactttctctgatgtcaagtttaaaaacttcatcacaaagtaaaaagctgaaaatgccccaaaatccccctggagtggtggcaagaaaatcccattgaaggcacactgggagtaagggcagtaactggtgttgaagagctccaggatgctttgatggcattgttgatagtttccaataccctggatttcaaactgctggaatggaagagtcatctcaaatctcttggtgcagggggtcttgtaaaggtcacttacgttcactaccttcttatatccaggatgaaagcatgggtccctgagaatttcattacttgcaacctgaatgtccttggccagtttctgccagagtgcctgatccttcccatagcacaagaagctatgtgtgtagacattgtagtccttgccatagaggcgaaattgcagagcattatctggggactcgatagtctggttttggggtacaaaagtgacttgtgtagaggctcccccaaggtccaaagctccaaaggtttcctgattattggtttcatatgggactatgctgaaccaccttgttttctgactgaatttgcccagcagatagttgatagtaatccagccataggcaccttcctcttggccagtaatgatcctggcaccctggaagtcaaaggggtagttgctgaggctcctctccaccacatccagaaccctgtctgccaactcttcactttccatcctgagcaaccgcatgcctgccgtggctcccaggtaaacgggtgtctcttggtgctgggaccttggaatcacttccctagctctttccatgcaatcagtcaggtaaatgcctatttcatttactttctgaacaaattttgagattccaggacctttaaccctgcattcttctacttgatgcaccacgcctgtgtcattctccttttctgctggccacttatagatgtataaacttgtgtgagaagaacccgcatccagcacaatcccatacttaacgttttctggcaatgctttgttctgggtcaaccccacagcaagcaaagctatcacagctatgatagaggagaagccaaggatggctaggatattcttggagcaaaatgtcttcacgttagactcctttgtatcttccataggcccaggattctcctccacgtcgccagcctgctttaacaggctaaaattggtggcgccactgccagacataaaaattttttgcttgaaagtaatgactgtgtagcacatgggacacttgtcaactgcttcagcacattgtttacaagtgactagatgtccacaaggaacaaaaacgatagcaatatttctatccatacagattttgcaaagcttctcctcttgcaggcgccttagctgctcttcagtactaatctctttctgtaatgaagtctgacttgactcatcttgcatactgtctttctgagcattcactagatctgcaaccagaacctcaagtgatttatagttgctcccagatatctgaattttttcctccattattttcttaatgtccttgaaactgaaccccattcgtatagcttcttgtaccataggattttggaagatggtatcatcaattcttctagttagtgatggtgttttctcagtagttcttaccagacactcctcaagtgaatgagttaaatgaatattgtttatatattcttgtcccttctgttctaacagatatttgcaccctggataccatttagcatgttgttcccaagggtcttcactgggcttccaatcagttagccctcctccacagtgaaagcactttactttatcaccttcacctaaagcataaaatccagctcttgcaagctgctccttgttaactgagtatatccatgtcccaaaagtaaagatccgtgcttcataatctgccatggatggatttcttggaagatttgttgaatttgggaaattcctatcagaactcacagcatcagattcacttcgaatattaagattccggcccaaaacaaagaagcaattaggaaagtgtcgcctgtgttctgaccaggcacgatcacaaggttcccaatttttcagttttccaccacaacaaaagcactgcacttggtcaccaatacctgtgtagtagagtccagcacttgctaactctcttggggttaggtgagcatagtctggccagttctgaaaggactttaatctagcttcttcactatacatggcagggttcctcgggtatatggtgtctgatatatctacaacctgcccagttctcaaaagatagtctgcatgtgtctcagatggcctgtctaaggcaaaatgatctctgcttcccagatagttttcaactttgtactgaccattctggataccagaatttgtagactgcgtggcactattttcaagataaaagccgttgataaatctgcaatttggggatactttcctgtgtcttccaactgctgagtctccatattgccatctatctacagctgcatgacaactaaagcaccgcacggtatctccttcaccagtataaagaaaccctgctcgtgccagtgttgatgctgaaacaggactaccacttggaaaattagcaaaagtttttaatctattaaactcttctacaaattcttcttccttattgatgtctgcaggtacacaagttttagatccttcaaaactgttaaaagtcatggtggctttcccatttttgcttagcttttagcgatggctttcacgacacctaagacgacaaaaaccttctttaaactactgtcccgacgaccggagactcaggcacaaccccaacagccaagggcaaactccagggagcattagcaccggcgccctgcgggccctgcccggcctacacccagcgaacggggccgccccggcgcccagcccctcccccacccgggccgcgagtcccgggaagcggcgcgggcagcaccgcccggccctttgtgcgccgcccgccgtccgcgtcctccatcttgagaccgggagcggccatctttccgcgctcgcagcccgcccgggcggggcgctgggtctccgaccgcccgccccgccccgccgcggccgtctgccccgggaccgccgggcacggaggccaccttgggcggcctcggctgggccgccctggcagtaacacgcggctgccggccgaactcgagcgcgaagacagacggggcgggcgcgaaggcgcggatcgcacgcggcggccacggcgccccagcaggccgccaccgggcacgcggtagggaaccgcgagagcggagggcctcgagttctccacctccccccgcccgcagctcggaatcaggaccagggcgcagagccctctacgcgcggggggccgggaggcacgctaaggccgtggccaccggcggaggccatgcggacggaggccacacccgtactcacctgtgtcctggcggcaaacccgttgcgaaaaagaacgttcgcggggaccacggcgcttatatatggtcctcccccaccctcggggaaaagggcggagccagcacacgacaccactttcccagtttaccccgcgccacctccacccggcaccggttccaccgccgtcccctccccccatcttcggggaccgtgggcgatgtgcgttcagcccactgacgagcacacggcgcccggcgcatgctcctctcaaccaggaggatgacgactgctggtgggtgggaggcggggtcgagcgctcactcggttctaggtttagtgggagtttatcgacggtccctgggatttccctggctgaggagagtcctccttttgtatgaattactctccgcacagctggggggtggggcggcggggaggcgtccagaatcttccctgaaccggtcgtagcttaactgcaaagttggaccgagatgggagcccttacccggcagtaccccaccggtcctcagtcttgcggtctcgcaggttaaggactaacccctggagccgcttcctctgccggggcttctccaccgcccttgccgtccgcgccccttccggctggagagggaggcgtaaaaggccggggaaccgcggcggcaggggcctcggggcggtcttcagggccgagaatccgcgagtggctcagtttgctgaccaacagcctggcgaacaggctcctgcgctgacctcttggctttttccattcagttcttttatctaagttcgttctacacaccacgtggtactccagacgtccagtttttgagtttagaatagacttaagtactacagttttctttacttctaatcctaattttattacgtttaagaccctgagtgtgtgtctaccctcctattaacattttttttccagtgtatactcttggttgcaagcatgaaaaacctaaaaagaattttttgagttcagtgcttatacacgatctcaagtagagactaagatctacagcgccaggaagcttatccacccaatttactactccaacgtttgctgtgaaatcactgtttctcaaaaatggcctatcccatttgaataaacggcttcatcttttgtcgtcctatccattgtgactgcattttaggcataaatccagggcaagacaagatgaggcctttttggttggcaatcaggcagatattcaaaaatattcctgaagaaagaggaacctttattttaaatgagctaattactagatcgtctcttccacgtgtagagcactactgcaactttttgagccaatctatcaacaaatatttgagaacctactatgtggccagagctaagagtggctccgaagcatatgcaaaagaaatacttcctttgggggaagaaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttaactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctga

SEQ ID NO: 224 - DNA, 26994 bp, synthetic construct
  misc_feature 1..26994: note = 18S4
  source 1..26994: mol_type = other DNA
agttaggggctattgcaattatccagcaagagatcttggaccaggatggcagcagtggaggtggtaaaatgtggttggatgaagcgtacgctttgaaggtatcaacaggaccagctgatggaagggagtcaacaggactagctgatggctgtaaactggggggtcactagctatcagatggcatttacttaaagccatggaagtaggtgagctcccttatggagagggaataggaaggaggtagaccattctatcaaaatgctctttctacagggcacttctcactgagatattatttatctgggatttatattatttattcaatttgttttgtgtttggttctattagaaaagctccataggggccgggcacgttggcttttgcctgtaatcccaacactttggaaggccgaggcaggcggattacctggggtcaggagtttgataccagcctggccaacatggtgaaactctgtctctactaaaaacacaaaaattagccgggcgtggtggtgcgcctgtaatcccagatgctgaggaggagaatcgcttgaacccgggaggtggaggttgcagtgagccgagatcgcgccactgcactccagcctgggcaacaagagcgaaactccctctcaaaaacaaacaaacaaacaaacaaacaaacaaaaaacaaaaaaaagaaagaaagaaagaaaagggccaggtgtggtggctcacacctgtaatcccagcactttgggaggctgaggcaggcggatcacgaggtcaggagatcgataccatcctcaccaacacggtgaaaccctgtctctactaaaaatacaaaaattagtcgggtgtggtggcgggcgcctgtagtcccaggtactccgcaggctgaggcaggagaatcgcttgaacccgggaggcggaggttgtagtgagccgagattgagccactgcactccagcctgggtgacaaagtgagactccatctcaaaagaaaaaagctccataggagaaggaaccttgtctcttcaccacataaactgtgtttggattcgcaatcgagttgggaaaaaaaaatcagtctggaagagccacaccaaaccgctaacagctactgtctctgggaatagaacaaggagtttggttggcgcgatataccgcccctgaacctctagccacaataaggcttaattaatgaccggacgacttgaaagcgccttccactgtttatctcttaaatctgcaacgaaatgcaacaaaaacgcaagaaataaacaatagaagcctcaagagaaatgttctggcacctgcacttgcactggggacagcctattttgctagtttgttttgtttcgttttgttttgatggagagcgtatgttagtactatcgattcacacaaaaaaccaacacacagatgtaatgaaaataaagatattttatttcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcataggtccagggttgctctcaacatctccagccaatttcaagagagcataattagtacactgtccgcttccacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcaagaataggtggtgccaagatcaatgccaactgcaggtcccttagacatggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatgctggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattaattgatgggaataaaataaggctgaaattgcttttcacattctggctctgttgggggcattttcacatagacccctgttgtaagagggcttcttttctttagcattttgctcaaagaaacagctgtgaggagaaagctataaaaaaacaaccccgaactaactgctgcaaggatccagaggaggaagtcagaatctgggcacggttctggatcaattacataaatctgggttccgttgcctatgcccaggtagtatggcggtgggtacatgagctccaccttgcagatgtagagtcccgtgtccatggccctcagtccttggatagtgaggttcacttgatttccactggaggtgcccgtgcagatggaatcatctaggaaggtcaactcattccccatcatgtaggttgccgcacagacttcagtcacctggctgtcagcctgccgaagcactgtcacccggacctcagtggctttgcctggagatgcatactcacacacaaagctggcgatgcctcggctgctggccagtaccacagcaggctgggccacgtgcattgctttgcagaagacagggatgaagagaagaaaaaacaggagagtgcagggccaggtcctggtagccaggttcagctgagccttgtgccgctgaaatccaaggcaagccataggcccaggattctcctccacgtcgccagcctgctttaacaggctaaaattggtggcgccactgccgccatacatctgcttgaactgaaagcattcgttgcagtagccgttgcacttggcattgccaaaatgatcacaggcgggggcccggcaacgctgcttgggggggtcttcgggggcaggctcaccccggtgggccccagggcccatcctctggttgggatgctgacactccatgcagagctcctcgctgcggcaggccaggatgttcttgcaggaggcccgggcgcacttgggccttgaggtgctttgtgtggttcgaggcacatctctgcgctggctcgatctcagttgctcttctgtccttttggcctcatgaaatctctgattctgagcttcaatgaaacacttctggcagtatccttcaaacatggtgcttccaagggtgccgcattccctccccaggcacggaatggtgttctggaacctggacgctgtgggactgactttccctgaggcagcagcaaaatgtttgttttctctgtactcgatgaaacacagtgtgcaaaagcccttgttttctggagtcccaaaatacacgcagccggcttttctgcacttgctcgtccccgtcctgtccccaggagtccgtgcagcttgagacaggcagccagcaggggcgtcgtttccagctctgtggcaagaatgcggggaggggctccggacgagccgcgagggatctgacttggaacgctggtgacaggaaggagggaggctggtgctgaggctggaggaggcctctgctgtagtccttttgaagcaagtactgcagatcccattaaatgtcctggtaacatcctggaggcaggcttggcacttcccgggatccaagtgccttgtgtggtctggggcgtggctggcgtgaagttgccgggcgttgtggcaacgttcacaaaatccgttgtgctgcacattcagtgtgaaggggcagccggggctcctgcacttcatggcagtggtctcactgaacagaaaagggctgggtgctgtcggtggggccgaatgaggccccccagtggactcctcagggttccacgccaagggctcataggcttctccccgagaggccccgagcgccatgccagggagcccctcagggcccggcttggagttcagctttgggagtttgttttgattcttttgccgcctctctgagcactcatggcataaaggctgggtgttcacagacatgaagaaggggcagttgggcgtttcacattttacatccatgagagaaagctggggcacggaaggttccatgggattctgggcgtgcccctctctcctcccctgctcgctgttttcctgccatttcttgtactcatgctgaacaagttcaaagtaatcatctaccagattgatttcttttggtaagttagcttcatccaactttgcggcattgatgagatgagttgtgccatggtcccagccttggacggggatttctatcaccattaagtactcttttaagagcttctccttcatctcattttcaggatctgtcaaaaagtgaacttttaagtcttcaaatcttccccggtctctgttaacaagtggaacagctcggatttcaggcccactgtccttcagggtcaccaagggtacaaaatgatggctgtcatagccgagaacaatggggtatctgtagcattcctgggcaggccagtggagaggcaagtaaattccacccactttcaaaggggcgaaattggaacctgattccaaacttcttagcattttgtctgaaatgacaatgattggccttctgaggatgttgcaaaggacaaatatgtgtatttcttccagtgagttgtactgaagtccacttcgggccatgggtgtgtctgtggaagccattttgataagattgtcccattcatcattccagttccgagtatcatagcaaagccccgtttcaacaaattcctgagatttgagagactccagttgccagcggaatttaaagttgcgtgtgtctgtttccttgagcgtgctgaacagcgccttcctcagtaccaagtctgtgtcctgaacgccccacatgtactgagaagtggcatgcatgaggcaattgccgtcaccgttcgttttcagcgccacaagcttccggacttctcgacaccagttgagtttcttctggctttccagggtggcctggatgtttctgtcgatgagggctttgtggatgatctcccgaaactgaggacaaaactggcaagttctgaacatttccagtgtgtatcggtgcatggttttaaaatgatgaatgatcccattagtaggtttaaaaatgtcttctggagttctctcccgtatcttcacagctttccgcatattgctcaaatacaaagcctgaggaaggacttgttcagccatggtggctttcccatttttgcttagcttttagcgatggctttcacgacacctaagacgacaaaaaccttctttaaactactgtcccgacgaccggagactcaggcacaaccccaacagccaagggcaaactccagggagcattagcaccggcgccctgcgggccctgcccggcctacacccagcgaacggggccgccccggcgcccagcccctcccccacccgggccgcgagtcccgggaagcggcgcgggcagcaccgcccggccctttgtgcgccgcccgccgtccgcgtcctccatcttgagaccgggagcggccatctttccgcgctcgcagcccgcccgggcggggcgctgggtctccgaccgcccgccccgccccgccgcggccgtctgccccgggaccgccgggcacggaggccaccttgggcggcctcggctgggccgccctggcagtaacacgcggctgccggccgaactcgagcgcgaagacagacggggcgggcgcgaaggcgcggatcgcacgcggcggccacggcgccccagcaggccgccaccgggcacgcggtagggaaccgcgagagcggagggcctcgagttctccacctccccccgcccgcagctcggaatcaggaccagggcgcagagccctctacgcgcggggggccgggaggcacgctaaggccgtggccaccggcggaggccatgcggacggaggccacacccgtactcacctgtgtcctggcggcaaacccgttgcgaaaaagaacgttcgcggggaccacggcgcttatatatggtcctcccccaccctcggggaaaagggcggagccagcacacgacaccactttcccagtttaccccgcgccacctccacccggcaccggttccaccgccgtcccctccccccatcttcggggaccgtgggcgatgtgcgttcagcccactgacgagcacacggcgcccggcgcatgctcctctcaaccaggaggatgacgactgctggtgggtgggaggcggggtcgagcgctcactcggttctaggtttagtgggagtttatcgacggtccctgggatttccctggctgaggagagtcctccttttgtatgaattactctccgcacagctggggggtggggcggcggggaggcgtccagaatcttccctgaaccggtcgtagcttaactgcaaagttggaccgagatgggagcccttacccggcagtaccccaccggtcctcagtcttgcggtctcgcaggttaaggactaacccctggagccgcttcctctgccggggcttctccaccgcccttgccgtccgcgccccttccggctggagagggaggcgtaaaaggccggggaaccgcggcggcaggggcctcggggcggtcttcagggccgagaatccgcgagtggctcagtttgctgaccaacagcctggcgaacaggctcctgcgctgacctcttggctttttccattcagttcttttatctaagttcgttctacacaccacgtggtactccagacgtccagtttttgagtttagaatagacttaagtactacagttttctttacttctaatcctaattttattacgtttaagaccctgagtgtgtgtctaccctcctattaacattttttttccagtgtatactcttggttgcaagcatgaaaaacctaaaaagaattttttgagttcagtgcttatacacgatctcaagtagagactaagatctacagcgccaggaagcttatccacccaatttactactccaacgtttgctgtgaaatcactgtttctcaaaaatggcctatcccatttgaataaacggcttcatcttttgtcgtcctatccattgtgactgcattttaggcataaatccagggcaagacaagatgaggcctttttggttggcaatcaggcagatattcaaaaatattcctgaagaaagaggaacctttattttaaatgagctaattactagatcgtctcttccacgtgtagagcactactgcaactttttgagccaatctatcaacaaatatttgagaacctactatgtggccagagctaagagtggctccgaagcatatgcaaaagaaatacttcctttgggggaagaaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttaactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctga

SEQ ID NO: 225 - DNA, 35546 bp, synthetic construct
  misc_feature 1..35546: note = 9M4
  source 1..35546: mol_type = other DNA
gctggagcagtttgtgttctgccacagaatgcaaatacataaatgtaagcaggaaaacggacagagtagagtccctagggcttctttttattttttctctcctaagctgcagattcccttttatggttatataactgatgatgacgcaagtcaaacctttcccgtccagctctcagatttcaccctttctcttggaaagaaaatgtttgctggtcactacgtagacactctcatgacgctgagttaagtcccatacaaggtggtgaccttcaggagagctgaatcctttggggaaaggaggaaaggcagacaggtaggctccagtccaatccccaacagcccaacacccaggccctttgtgagctcagcccatcacgtgctcttgcctgcccgccaatcctgccgtgttgctgggcctctgtcactcttccattggtgccagctctgaagccatcccttctggggcacctgcaaaggatggatcagtgggtggaaggaactgaaaatggatccaatgactcatcctgcttctggcatattctagcacattgcattctaggtcaagggattttaggttgtaggaacgtgacttggtacacgatccccgaatccaagtgggacatttagactttgggagcccttctcagcaaacagaaaagcagctctaacaaaaacaacaaaaatcctccgtagagcagaatttgtcaacccattgcattgctgactttgggggctgggtaattctgtttttgtgggggactggccactgcaggatgtttagtaacatccctggcctctaccactagattttagcggcacacctcaaccccaacaccacagctgtgacaagcaaaaatgtctccagatactgccaagtgtccaccaagggaccaagtcgctcctggttgagaaccactgctctagagaaacagcatctacctccctgagagtttacttccccctcctccctttcacttcagtgcccttggacaaatgtttatttctatttgcttcaacaaaacccactgttggacttagagaccaaaattctctagtagagaattttcctgctagagacaacatcagtgttgttagcgcctaagaatattgttttctctttggagatagccctgggacccagtcctcacccttggagcctttcttcttccccctctccccctctttctccttttcaccttcccttgcctctgaaatcaggtctgtttttctctgtagtttttggactcttgaaaaaaaagctatgtcacaaagctcgtgactcagcctttaaacaacatgaatcataagacctgcagtgaaagaacagccaaaagaaaacagggtgtggtttgaagccaggcctagtcacctgagaaagaacctcagctttttgttcctctgaaaacttctttctggaattcaagaaggaaaccttatacagagctttgatgttctgttcctttaaaccctcttttcagaaatttagaaatatccctcacagaaatctctactggaagtcactgaggtctcctgctaaactgaaaaatgacattttatttttattattcatttacatttcttggtaatgaattcattctctttgaaaatgtttaaaacgataggagttaaagtctgttttgaatactgcttagacctttcccataaatacctacagacacaggttgccaaagaaaacatagttttgtttttattctcattttaagtacagtatttaaataacataatgtttataattccaacaggaatgtagtcttttcctaatagcagggtattttttagtcggttctctctttttctatatatttattgaaagcttcaagggtaaaaattaaaaacaccctccccacatttatagaaatagagaatatttctagaagagtctagaaagaacagtggctagggaattgagtgcatgagggaggtttttcattataaactatagaaaacctgttttaagttttcatcacgttcatatattttaaaacatttttaaaatatgcctttggaaaaaaatttaagtatgctttttgaaaaaaggaaaaaatatgctggagaaatgacacagagatcacaaaataaaatatcaaaatgaaaaagatctgactggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactattacgtctcctccaaatgtgtatcactttgcttctttgagtttgtatcttggatgccacattttttcacatccatcattctcccttttcttaaacggaagatgaatgtcagtgctacaccaaggcataataagatggctcccagaattaccaagtgagtcctttcatttggaggatgtgccagaggtagttctgggatgaccaattcagctgtatggttttcctcaggatctaatctcctaaaagtgcagtagaaaatctcattagttgttgtgttgattctcagtgtgctggtcacattgaaaagcttctcctctctcttggaattggtggtggtggtcttaccactcaggacttgatggtcactgcttgtccagatgacttcggccttggggtagccctcagcctgacatgtcagttcatgttcagaggtgactggatccacaaccaaaattctttggttgattttgttgtatggggcattgactttcacagtaattcgcttgtagtcggcaccaccatagctgatcatgcagcggtacacccctgcatcctgcaatttcacatctgtgatctgaagtgcagcatttcccagggagagctggtccttcaacagccgggccctctgtctgtagctactatgctgaaccttcaggtcttcctctccatgcacaaattgaataatgttcttatcctccatttcccaatagacaattagtgcagccaggtctaattgtttttctactgggaatttgcattcaattgtcatattgctaccatactctaccacatataggtccttgggaaccgtgacagtaaatgcgttcagcaaatgccagtaggtcatgaatataaagacagcaaatatcctcataggtccaggattctcctcgacgtcaccgcatgttagcagacttcctctgccctctccgcttcccatggcataaagccctacagcaactgtcgccaccagaaagctgagtgtaaggacccatcggagaagcggagcctgggagcgggtgttgagtgggggcttccctctgggagtctccacgggggcagaatcttgcactttgttgctggcccgctggcgaagccctggtgcccgtgaggggctctggtccttggtgtcatgggtcagcagctcctgcaactcctcaaagagctggatgttgagcaggaacgcagtcttggcctcttctatcaccctctgcctgactgcgggagtcatctccagggagttcatgcgggagcggtagagctgcttgaacttggtggcactggcaatgttggggaaggtgaagaaggccaggccctcgccagagctgggcaggtccagggctttctgggcaatctttttgagcacctggcccccagacaggtcacccaggtagcgggtgtaggcgtgggccaccagcagctcgggctctgtgcgccccacctcgtggagccgcttcacatagcgctgcatggctggtgtgtaggggatgacctcctgccagcggggcccgtaccagaaggccaggtcctgctccagggcagccttgcggtgcagctcttctgggaagtagacaggggcgaagactgggctctccttgttgcgctcaatctcctcctccagggccacatagatgtggtacagggaggccatcaccagcttgaagccgtctcgggtcacctggcccttctgaaagttcctcatgaactcagcattctctgcctgggtgtgcacctccttggtggcctccttcagggcctctgacaaatcctggggcatgctgtcgggttgcggacgctccataggcccggggttctcctcgacgtcaccggcctgtttcagtagtgagaaattggtggcgccgctgccgccatacatctgcttgaactgaaagcattcgttgcagtagccgttgcacttggcattgccaaaatgatcacaggcgggggcccggcaacgctgcttgggggggtcttcgggggcaggctcaccccggtgggccccagggcccatcctctggttgggatgctgacactccatgcagagctcctcgctgcggcaggccaggatgttcttgcaggaggcccgggcgcacttgggccttgaggtgctttgtgtggttcgaggcacatctctgcgctggctcgatctcagttgctcttctgtccttttggcctcatgaaatctctgattctgagcttcaatgaaacacttctggcagtatccttcaaacatggtgcttccaagggtgccgcattccctccccaggcacggaatggtgttctggaacctggacgctgtgggactgactttccctgaggcagcagcaaaatgtttgttttctctgtactcgatgaaacacagtgtgcaaaagcccttgttttctggagtcccaaaatacacgcagccggcttttctgcacttgctcgtccccgtcctgtccccaggagtccgtgcagcttgagacaggcagccagcaggggcgtcgtttccagctctgtggcaagaatgcggggaggggctccggacgagccgcgagggatctgacttggaacgctggtgacaggaaggagggaggctggtgctgaggctggaggaggcctctgctgtagtccttttgaagcaagtactgcagatcccattaaatgtcctggtaacatcctggaggcaggcttggcacttcccgggatccaagtgccttgtgtggtctggggcgtggctggcgtgaagttgccgggcgttgtggcaacgttcacaaaatccgttgtgctgcacattcagtgtgaaggggcagccggggctcctgcacttcatggcagtggtctcactgaacagaaaagggctgggtgctgtcggtggggccgaatgaggccccccagtggactcctcagggttccacgccaagggctcataggcttctccccgagaggccccgagcgccatgccagggagcccctcagggcccggcttggagttcagctttgggagtttgttttgattcttttgccgcctctctgagcactcatggcataaaggctgggtgttcacagacatgaagaaggggcagttgggcgtttcacattttacatccatgagagaaagctggggcacggaaggttccatgggattctgggcgtgcccctctctcctcccctgctcgctgttttcctgccatttcttgtactcatgctgaacaagttcaaagtaatcatctaccagattgatttcttttggtaagttagcttcatccaactttgcggcattgatgagatgagttgtgccatggtcccagccttggacggggatttctatcaccattaagtactcttttaagagcttctccttcatctcattttcaggatctgtcaaaaagtgaacttttaagtcttcaaatcttccccggtctctgttaacaagtggaacagctcggatttcaggcccactgtccttcagggtcaccaagggtacaaaatgatggctgtcatagccgagaacaatggggtatctgtagcattcctgggcaggccagtggagaggcaagtaaattccacccactttcaaaggggcgaaattggaacctgattccaaacttcttagcattttgtctgaaatgacaatgattggccttctgaggatgttgcaaaggacaaatatgtgtatttcttccagtgagttgtactgaagtccacttcgggccatgggtgtgtctgtggaagccattttgataagattgtcccattcatcattccagttccgagtatcatagcaaagccccgtttcaacaaattcctgagatttgagagactccagttgccagcggaatttaaagttgcgtgtgtctgtttccttgagcgtgctgaacagcgccttcctcagtaccaagtctgtgtcctgaacgccccacatgtactgagaagtggcatgcatgaggcaattgccgtcaccgttcgttttcagcgccacaagcttccggacttctcgacaccagttgagtttcttctggctttccagggtggcctggatgtttctgtcgatgagggctttgtggatgatctcccgaaactgaggacaaaactggcaagttctgaacatttccagtgtgtatcggtgcatggttttaaaatgatgaatgatcccattagtaggtttaaaaatgtcttctggagttctctcccgtatcttcacagctttccgcatattgctcaaatacaaagcctgaggaaggacttgttcagccatggtggcggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatggggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgactggcagtggagccaccaacttctcactccttaagcaggctggcgacgtggaggagaaccccgggcctatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctgataagctccctttcctgctttccaggaaaggttttttcatcctcagagcccaaagattgaatatggaaaaattatgaagtgttttgagcatctggcctctgcctaataaagacatttattttcattgcactggtgtatttaaattatttcactgtctcttactcagatgggcacatgggagggcaaaacactgaagacataaagaaatgaagggctagtcgagaccttgagaaaatatatcagtatcttggaccccatgacagcagtggttgtaaatagctgatgttatggaaaacaggctttgctccttagccttactctcccttaaagaattcaagttgcagcttgatttgggagttagatattgctaaattttatttaaataaattatgttatttaccctttcttgtaaatgtcttctttctctttaattatccagaatatcacttagattcattaagttcttctgcctaattacaccactgttttaagattttctttttgcattttactgtccccatttctctttctcccctgttctctttttatcctagttttctctgccatcttaaaagaactacaagaaagacagaaccttctgtgctggattcggaaaatgacatatgaattatgagtaatccttgttccttcttgcatcctaattctgaatctcagttcagttcacttcagtctctcagttatgtacgattctttgcaatcccatggactgcagcataccaggctcccctgtccatcaccaactcctggagcttgcttaaattcatgtccatcgagttggtgatgccattcaaccatttcatcctctgtcgtccccttcctctgctttcaatctttcccagcatcagggtcttttccagtgagtccgttcttcacatcaagtggccaaagtgttgaagtttcagcttcagcatcggtccttccaataaatattcaggacttatttcctttaggtttgactggtttcatctccttgcaccccaaggtactctcgagagtcttctccaacatcgcaatccgatggcatcaattctttggcagtcagctttctttatgatccaactctcacatccatacatggctactggaaaaaccatagctttgactagatggaactttgtcggccaagcaatgtctctgctttttaataagctgtctagctttttatagacagcttattatagcttgttatagcttttcttccaaggagcaagcatcttttaatttcatgtctgcagtcaccatatgcagtgactttggaggccaggaaaataaagtctgtcactatttccactgcttccatctctttgcaatcaagtgatgggaccggatgccatggtcttcattttttgactgttgagttttaagacagctttttaattctcttctttcactttcatgaagaggctgtttagttcctctttggtgtctgccataagggtgggtgtcatctgtatatatgaagttattgatatttctcctggcaaccttgattccagcttgtgcttcatccagccctgcatttctcatgatgtactctgcatagaagttaaataatcgaggtgacaatacgcagctttgacctatttctttccctgttctgaatccagttggggagatgctgaaagtaacacatctaacaagtgactgtaaatgagtgtattcaaggtttttatgagatcagataatgaagcccttggtatgaaatgggtagtaaagataagtagtacagacaattgtccaaaagacaagaagacaaaagtcagaaaagcaaaggatagcataggccaaatcactgatgaataatgtgtttgtgtattctgagaatttcaggtaaacagaaaaacaaatgaagcaaaactgcctgggatagaatagaatagatactatattttggtgtacactgtggacacattcttaaagttaaaaattcaccaagaagattccatctagacattactcacaagatatttgcactggtaatcagccacagaatgaggtgtccataggcattaaggaaagtggtagaaaagaagcacccagcgtagctcgggttagtgaaccgaggcacttcatgctgcatatttgtattgcacgtttcagtgtacatcgtgtttcacttcctatatctcgttggacacttcagtttgccatatgatatgtccagggggttcaggcacggaggaagggcctcggaagacctcggggggagaggggcaggcactgctgtgtattgatggggggattgtttgcactggttgatgatctctgaacaaccaagaagtacacaaggatctacctaactggacgtgctaagtaatttcactttggggattattctccagggagacgatccattgatagagaagtgaaaagcatcgagatgtgtctagtagttgtaggaagtctggggtgctttcctgatggggtgccctcagctggaaatagcccctccttcctttgacctgtcctgtggctatttgcagacattttattcctcttaccagactgtaagctctttgaggctggatttctgccttttgtctattcattcattcactcattcttctattcatgcattcaccaattccacaagtagttgttgcctgtaacatgtgccagagattgtaccaggcagatgggcatatctagataagcaaaagacatgatcctttctcttctggagctaacaatctactgggggcagagataatagcaaacaagtaaatatataatggttaaatagaaatttcgaatttggaacattctcatgaggaaaacagctaagatatggagggagagaagaagccagaaggtgacgggacgaggcagctggcacagccctaggcccaggaattcaacaggcatctactgagtggacccaacgcatgagaggacagtgccaagcaagcaactcaaatgtcccaccggttgggcatggccaggtagcctatgctgtgtctggacgtcctcctgctggtatagttattttaaaatcagaaggacagggaagggagcagtggttcacgcctgtaatcccagcaatttgggaggccaaggtgggtagatcacctgagattaggagttggagaccagcctggccaatatggtgaaaccccgtctctaccaaaaaaacaaaaattagctgagcctggtcatgcatgcctggaatcccaacaactcgggaggctgaggcaggagaatcgcttgaacccaggaggcggagattgcagtgagccaagattgtgccactgcactccagcttggttcccaatagaccccgcaggccctacaggttgtcttcccaacttgccccttgctccataccacccccctccaccccataatattatagaaggacacctagtcagacaaaatgatgcaacttaattttattaggacaaggctggtgggcactggagtggcaacttccagggccaggagaggcactggggaggggtcacagggatgccacccgggcagctataccatatctttccagaaatatgaaggcttgtgaaagataagcaagcctatgatggccactgtgaaaaggaccagggagaatagaaccatgaggaagacataggtggagtgggagagaggtgtggacaatggttgctcagctgggatcatgttggtcaggttcagcatgtagcccaaagtccagccggcgtcgctgccctggatcttgccaatgaaatggatgtgctcccaggaatcagctgtgaaatgatagccttgcagaaggagggagagaatgtaggtaccagaaaagcagtattcactcaggtacttctcctttactccagcgtaagatgtttttatctcctcccaaggctgagcacagaactttttcatcatctcagtcaccttttcctgagagactttctctgatgtcaagtttaaaaacttcatcacaaagtaaaaagctgaaaatgccccaaaatccccctggagtggtggcaagaaaatcccattgaaggcacactgggagtaagggcagtaactggtgttgaagagctccaggatgctttgatggcattgttgatagtttccaataccctggatttcaaactgctggaatggaagagtcatctcaaatctcttggtgcagggggtcttgtaaaggtcacttacgttcactaccttcttatatccaggatgaaagcatgggtccctgagaatttcattacttgcaacctgaatgtccttggccagtttctgccagagtgcctgatccttcccatagcacaagaagctatgtgtgtagacattgtagtccttgccatagaggcgaaattgcagagcattatctggggactcgatagtctggttttggggtacaaaagtgacttgtgtagaggctcccccaaggtccaaagctccaaaggtttcctgattattggtttcatatgggactatgctgaaccaccttgttttctgactgaatttgcccagcagatagttgatagtaatccagccataggcaccttcctcttggccagtaatgatcctggcaccctggaagtcaaaggggtagttgctgaggctcctctccaccacatccagaaccctgtctgccaactcttcactttccatcctgagcaaccgcatgcctgccgtggctcccaggtaaacgggtgtctcttggtgctgggaccttggaatcacttccctagctctttccatgcaatcagtcaggtaaatgcctatttcatttactttctgaacaaattttgagattccaggacctttaaccctgcattcttctacttgatgcaccacgcctgtgtcattctccttttctgctggccacttatagatgtataaacttgtgtgagaagaacccgcatccagcacaatcccatacttaacgttttctggcaatgctttgttctgggtcaaccccacagcaagcaaagctatcacagctatgatagaggagaagccaaggatggctaggatattcttggagcaaaatgtcttcacgttagactcctttgtatcttccataggtccagggttgctctcaacatctccagccaatttcaagagagcataattagtacactgtccgcttccgagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcataggcccaggattctcctccacgtcgccagcctgctttaacaggctaaaattggtggcgccactgccaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggctttcaggagcttcttggagacggtggtctccagaccactgttctcaggctgagtacagctggcactacagttaatcacctgggaccttccagactccaccaccagctgcttcgtccacgtgggtttctcgaacgcctccttgccagaccctggaagaccagagacactgggcagcaggtgtccccgcttccctgcccagtggaactgcccacggcaggccatctgatcaaggggtaggggtccaaggagaaaggccagggatggcccctctgcttctctccccttgttcagaacgtatggcctcaaatctagacccaggaggctgcccctgtccccaggctgtctccctgcctctggttgctgtccctccagctcgtgacctccagatgagtctttctcatgcacatcttctaaatccgtggagtgagaccttatttgaccttcatggcccagcccaaatgtcccctcatgaaggcctctctgaagtggaggcagcttgtgtcctctgagcccgcatggtcatgggttcgactctttcccccctccgcccttctcctgcaaatcctttttgagcatctcttgggtgccaggcactgttctaggctccggggacccagcaggacccaagcagacctcaccccacccttacagagctcacaaagtaaaggagacagaccataagcagcaaaataggcaggctgttgctggtggcaagtgactgggaagggaaatggggtgcgggtatcatgtgaaagagtgtggtcaacacaggcctcactgaaacaccgaggtttgtgcaaagacatgaaagaggttgggggagcctggcaggtgcctgcggtggggagggaaccgccagtgccaggacctcaggcagggaggagcccaggatggctggagctcagggaggaggaaggtgggggggcaggggggaggcgagtcaggaaggtcatgggaccactttgcaaatgactcacattcctgctgcctctcctttgctgcctctcccattttggagtttctagagggcagagcctgggtttcacatgtttcctttgtgctcagcacaatgctccccctgtgtgtggcatcaggccaagaaatgttccaggcacgaagacagagccctcggcgctcacctcccactcagtgatcaccagaaggtccttgatccccacctgctgggcctggcctgtgtcctgttggctcctgccacaccggcatgcccccacttagccctcagctagcagcatagaaagaaggggcaagagaggcagggaaagagaagttggcggggtttgtttgtttgttcgtttctttggctttttatggccacacccgtggcatatggaagttcccaggctaggggctgaatcggagctgtagccactggcctacaccacagccacgccagatctgagccatgtctgcaatatacacttcagctcaaggcaacaccagatctttaacccactgagtgaggccagggattgaacccacatcctcatggatactggtgggccttgttactgctgagtcacaataggaacttccaggaaagagagatttgaatcttgaatttgcccggtgccagtcgtgtggcgttgagcaaagtgctttctctctctgagcctcagtttcttcctctgggccaataatccctttcctgcagggttgtcatgaaagtacatggcaggtgtgctcagcacacggtggcattttccttcaagggccctttgaccccctcgaaggggtttcattttcactttgagtggacccagaaggtgatgccctctgctgccccctaggccacactggacaacaagctgggaactcccttcacctcccgagcatcccgcctagcccaccattcagtctccacgacctgccacatccacatgccatgaagctatggggcctgttgaactggatgcccaaaaggccaggacccccacccgctgcccggggtcatggggaagccaggctggaacagcctccggtacccatgatgggcagccgctgtgttcaaagcctccgcaacttccagccccgaagccaggggaacagacgacccaccctctgggctggcagacgcccagtcggaaaccccaggcgctggcttacctgggcagcagagcagggcgagaaaggccatgaacagtccccaggaatcaaaaggggactacttgagtggcacccacgggctggcaggaaagagctgaggaccgcctggcgagagatgggggcgcaggtcagggagtggtggccgggagccgcaatccggaacccccagccatctgtgtgccgatgaccacacttcctctcattatttgaggaagacgtggcgcccagggctcaggtctataagcaacaggcagaggaagctgggaaagagctgataagcagggataaccttgtcatcctggcatgctcccatcaggggacacatgtgacagtgctgcatgtgcacggaggacagtgatgcccacaagccccagatctggggagccccaaatcccaggggacacactgtcagggtcccctctgggaagggactatccaaagtcaggacccggccagggcatgcagtcaccatgactaagtgggcagagaaacccgggcaggaactgctggtgctttagtcaactgcctggcacaagtctgcttaaacctggacactccgctttcaatctcagccagcctctgactccctgatacaagacaacttgagggcggcactcccatcatggcgcagcggaaatgaatctgactaggaaccatgaggttgaggttcgatccctggccttgctcagtgggataaggatccggcgttgctgtggctgtggtgtaggccggcagctacagctccgattagacccctagcttggggacctccataaaaggacaaaagacaaaaaaaaaaaaaaaaaaaaagacaacttgagggaaacgcactcagcatagtccccagcagccccagcatagtccccagcaggcgcagacagaagtaactcggggaggcttcctgggctagcttagggtgcacccccactccagacagggggccttgatgggggggggtagggctgaggacttgcagtgtgtttctagagaggctttgtcaccactgagggcatccctggaaacagtgcgcaggtgaggggggattcgatggtccggggtcggggtggcgatccccccccagggagcttttcatcatgatacatccagtctccgaaggccccagttacacccagagcctcaggaccggcagggcctgggaggggcaggagaataggtctgcttgctttctcaggggtgcccctgcttggtccttttcaaagagacaccccagccttttaaggactcaggcctccattcctggattcagagggtgggatgaggtcatgcccttctcttcggctctgaggccaaaggccattgccattgtgtgcagctgtcaagtgctgccactgccaacctggatgcagggaagttcctggacagcactgggtgggcttcagaccatacagagagaagacggagaaaagggcagcgctctcaccccagaccagagatccgatgccacatgggcctgcaggaaacactcctccaagccaagctagaccctgaggaggtaaccccacgggctccgaataacaacatcgataacacagcagtaaacatttactgactacaggtcagacgctgttacaagcactccacaaatattagctaattaaccccaaactctatgtggtaagtactgttactgtccccatgttacagatggggaaactgaggcccaaagtgattaagtgacttgcccagggtcccgcacctgggagagaggtgactgccgaagcccatcacagcagaggcaagaggaggattctcaggggcctgatctccaggagaccctcgggagggaaaggcaagatggccagaggagacggctggggtcttccttgccaggaggggctgggggaaggagggtggcttatgcccagagagctccaaacagcttctggaaggcacagtgcctgtggatccctgctgcacatgcatctgggccagcctgactccatcccactggtgtccaagtgaggcttgagacccacaagtcctgcgccaaacccaccagcccctgctcctgcccatgacttcttcccatccccttgggtaggcccccttgaccagggtaccccaggcacgtgaacgtggctttgttactgcatttttatagcttatacatcgatctcccctcctgcccactggcctgtccacccgtgggggcagaagctgaatcttatgcactgcaatatccacctccgataccacactgccttgcacatggaggtgcttgataaataaatgttcaatcactagattagtgggtgggtggatggatggatgggtgagtgggtaggtgggtggacggacggatggacggatggatggatggttggatggttgggtaaacaaatgaatgaaagaaatgaataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcc

SEQ ID NO: 226 - DNA, 29619 bp, synthetic construct
  misc_feature 1..29619: note = 17M4
  source 1..29619: mol_type = other DNA
gctggagcagtttgtgttctgccacagaatgcaaatacataaatgtaagcaggaaaacggacagagtagagtccctagggcttctttttattttttctctcctaagctgcagattcccttttatggttatataactgatgatgacgcaagtcaaacctttcccgtccagctctcagatttcaccctttctcttggaaagaaaatgtttgctggtcactacgtagacactctcatgacgctgagttaagtcccatacaaggtggtgaccttcaggagagctgaatcctttggggaaaggaggaaaggcagacaggtaggctccagtccaatccccaacagcccaacacccaggccctttgtgagctcagcccatcacgtgctcttgcctgcccgccaatcctgccgtgttgctgggcctctgtcactcttccattggtgccagctctgaagccatcccttctggggcacctgcaaaggatggatcagtgggtggaaggaactgaaaatggatccaatgactcatcctgcttctggcatattctagcacattgcattctaggtcaagggattttaggttgtaggaacgtgacttggtacacgatccccgaatccaagtgggacatttagactttgggagcccttctcagcaaacagaaaagcagctctaacaaaaacaacaaaaatcctccgtagagcagaatttgtcaacccattgcattgctgactttgggggctgggtaattctgtttttgtgggggactggccactgcaggatgtttagtaacatccctggcctctaccactagattttagcggcacacctcaaccccaacaccacagctgtgacaagcaaaaatgtctccagatactgccaagtgtccaccaagggaccaagtcgctcctggttgagaaccactgctctagagaaacagcatctacctccctgagagtttacttccccctcctccctttcacttcagtgcccttggacaaatgtttatttctatttgcttcaacaaaacccactgttggacttagagaccaaaattctctagtagagaattttcctgctagagacaacatcagtgttgttagcgcctaagaatattgttttctctttggagatagccctgggacccagtcctcacccttggagcctttcttcttccccctctccccctctttctccttttcaccttcccttgcctctgaaatcaggtctgtttttctctgtagtttttggactcttgaaaaaaaagctatgtcacaaagctcgtgactcagcctttaaacaacatgaatcataagacctgcagtgaaagaacagccaaaagaaaacagggtgtggtttgaagccaggcctagtcacctgagaaagaacctcagctttttgttcctctgaaaacttctttctggaattcaagaaggaaaccttatacagagctttgatgttctgttcctttaaaccctcttttcagaaatttagaaatatccctcacagaaatctctactggaagtcactgaggtctcctgctaaactgaaaaatgacattttatttttattattcatttacatttcttggtaatgaattcattctctttgaaaatgtttaaaacgataggagttaaagtctgttttgaatactgcttagacctttcccataaatacctacagacacaggttgccaaagaaaacatagttttgtttttattctcattttaagtacagtatttaaataacataatgtttataattccaacaggaatgtagtcttttcctaatagcagggtattttttagtcggttctctctttttctatatatttattgaaagcttcaagggtaaaaattaaaaacaccctccccacatttatagaaatagagaatatttctagaagagtctagaaagaacagtggctagggaattgagtgcatgagggaggtttttcattataaactatagaaaacctgttttaagttttcatcacgttcatatattttaaaacatttttaaaatatgcctttggaaaaaaatttaagtatgctttttgaaaaaaggaaaaaatatgctggagaaatgacacagagatcacaaaataaaatatcaaaatgaaaaagatctgactggtgatctttttcttttatccaaatggaatttgtctatagatttaaatttcatacttggggtcttttttccaccaggactatacagaacttacaattagtgtccttttaaaaatctcaggctcagcgataagaaaggaaatgtatatatatgcatgactatcattttgctgtaaagcagaaattgacattataaatcaactacaataaaaaacttcattaaaaaataaaattaaaaaaaagaaaaaaagaaaacgtgggtttaaatagatttgatttctgatttctgagttcaaatggcagcagaagtgaaattctgatgccttcttgctcataatcgggaacaaaacaggaaggccgaagagcaatccgcaaagttctgtcagctttcaggtccagcgcaaggagtgtttcacagctgtgtggaatttttgcttttacttttcaaaattcaatgtgaacttgtcacaggcatttctcctttggacacttatttttcactcctgcgttgtgagaaaattcctgcaggtcctgacgaccctcctgaggcgggcttgaggcccggccccgagatttgtcgagtcattcctcttgtcccggtgcccgcccgcagggggatgggttcggccgccacagttggggtgactagaccccccgggaagtcctcgcgacccactgggggtgaggggaagtttatggaaacagaaacactatcgttacctatgggagacccagaataaagaccccacggtttcgctggcggggaagaggggttggggggaggggcacggcggaactcgggccaggggagcgggaccccgattcatcgtgaggcgctcggcgggacccctgttagccgagggcgggtctcaggaaaggcgagccttcctggttgaggggagggggcgccggggaccggcagcggggacagccccctccggacgctcagaggactccgtgtcgggttttcgcaccttccgcggcacctcccccacaccccccccaaccagccgagtaccggccctgtccgcggacgcagtgttcagcgaacacgctgatccctccgctcggccgctcaggactaaggcctcgtcccccccccccaaaatcagccccagtgttcgagtcttcacaggaaagcattctaggagtgaaattagaagattctggggggactgcttctctcttcagagggcaggaagggccgcgaaaagtagtcccttctcggcgtttctgcggaggaatctactggggcggtgctaccgatggctatataaggaagcaccgggtgtggcgcaggcagtttcgtggaggccgggagtttgcctgcgtttcttctgtgaccgctgttgccactgccacctggtgaggcggacgtccgggggtcttgcggctgcgggggtgggtgcgggaggtctgcttgcccgccgcggcggaagggcagccgagctgcttagtcacccggggccctcgtgcggaatagccttaagacgaacggccacctagagcaaaatggcggccgttcccaatctctctgtgggagaagccggcctctgaagcgggctctgaggtgggagagagaaattgggggcgggcgaggagcactgggtgaaacggaaacgagaggcgcggaggcttccattgatggcggggcccggccgtttgtggaacggggttgtgcagtgtttcggggatcgaatgctaggtcattgctttccggctcgactggctggctggcgcgcggcgagaacttcggttttccgtccctgtgaagggacactaactgctggtgccgctgagttggcctgaacgcttctggggcaggggacttgcgatccacgaccgtgacgaggcctcacccctttttgtgggctcatagcctagggtggggccacctgccgctatgtgtgtaggaagatgtttagtagtttggggacacagggtttgggcctggggtaaacgctgccgtgttgacagaggacagacatccattgagggggaggataagtaggtccgcgaatttacctgggtcaggtttccatgttttgctttcttaaacgcctgagacgttggatttgaggttaattgtcaagcctgtgaggtttttaggcacgtcagttatttggctactacaaagtgataatgaattatttagcactgggtatatattggcctgtgaatttcttgctgaactttgggcttttttttttcctgttgtttttgtgttgtaacagacagccaccatgtctcgctccgtggccttagctgtgctcgcgctactctctctttctggcctcgaggctgtcatggcgccccgaaccctcttcctgggttgcggcggttccggtggtggcggttctggtggtggcggctccatccagcgtacgccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgcgacatgggtggtggcggttctggtggtggcggtagtggcggcggaggaagcggtggtggcggttccggatctcactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctgctacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgggaagcggagctactaacttcagcctgctgaagcaggctggagacgtggaggagaaccctggacctatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaacaaaatgaaatgaaatcagacccttgtcttacaccataaacaaaaaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagcttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactactataccatatctttccagaaatatgaaggcttgtgaaagataagcaagcctatgatggccactgtgaaaaggaccagggagaatagaaccatgaggaagacataggtggagtgggagagaggtgtggacaatggttgctcagctgggatcatgttggtcaggttcagcatgtagcccaaagtccagccggcgtcgctgccctggatcttgccaatgaaatggatgtgctcccaggaatcagctgtgaaatgatagccttgcagaaggagggagagaatgtaggtaccagaaaagcagtattcactcaggtacttctcctttactccagcgtaagatgtttttatctcctcccaaggctgagcacagaactttttcatcatctcagtcaccttttcctgagagactttctctgatgtcaagtttaaaaacttcatcacaaagtaaaaagctgaaaatgccccaaaatccccctggagtggtggcaagaaaatcccattgaaggcacactgggagtaagggcagtaactggtgttgaagagctccaggatgctttgatggcattgttgatagtttccaataccctggatttcaaactgctggaatggaagagtcatctcaaatctcttggtgcagggggtcttgtaaaggtcacttacgttcactaccttcttatatccaggatgaaagcatgggtccctgagaatttcattacttgcaacctgaatgtccttggccagtttctgccagagtgcctgatccttcccatagcacaagaagctatgtgtgtagacattgtagtccttgccatagaggcgaaattgcagagcattatctggggactcgatagtctggttttggggtacaaaagtgacttgtgtagaggctcccccaaggtccaaagctccaaaggtttcctgattattggtttcatatgggactatgctgaaccaccttgttttctgactgaatttgcccagcagatagttgatagtaatccagccataggcaccttcctcttggccagtaatgatcctggcaccctggaagtcaaaggggtagttgctgaggctcctctccaccacatccagaaccctgtctgccaactcttcactttccatcctgagcaaccgcatgcctgccgtggctcccaggtaaacgggtgtctcttggtgctgggaccttggaatcacttccctagctctttccatgcaatcagtcaggtaaatgcctatttcatttactttctgaacaaattttgagattccaggacctttaaccctgcattcttctacttgatgcaccacgcctgtgtcattctccttttctgctggccacttatagatgtataaacttgtgtgagaagaacccgcatccagcacaatcccatacttaacgttttctggcaatgctttgttctgggtcaaccccacagcaagcaaagctatcacagctatgatagaggagaagccaaggatggctaggatattcttggagcaaaatgtcttcacgttagactcctttgtatcttccataggtccagggttgctctcaacatctccagccaatttcaagagagcataattagtacactgtccgcttccgagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcataggcccaggattctcctccacgtcgccagcctgctttaacaggctaaaattggtggcgccactgccaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggcggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatggggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggcggaagcggagtgaaacagactttgaattttgaccttctcaagttggcgggagacgtggagtccaaccctggacctatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgactggcagtggagccaccaacttctcactccttaagcaggctggcgacgtggaggagaaccccgggcctatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctgatagcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgattatatggccacaaccatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggcggcagcggcgccaccaatttctcactactgaaacaggccggtgacgtcgaggagaaccccgggcctatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgggaagcggagagggcagaggaagtctgctaacatgcggtgacgtcgaggagaatcctggacctatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaataactgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgcttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgaataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcc

SEQ ID NO: 227 - DNA, 29169 bp, synthetic construct
  misc_feature 1..29169: note = 15S5
  source 1..29169: mol_type = other DNA
taagctccctttcctgctttccaggaaaggttttttcatcctcagagcccaaagattgaatatggaaaaattatgaagtgttttgagcatctggcctctgcctaataaagacatttattttcattgcactggtgtatttaaattatttcactgtctcttactcagatgggcacatgggagggcaaaacactgaagacataaagaaatgaagggctagtcgagaccttgagaaaatatatcagtatcttggaccccatgacagcagtggttgtaaatagctgatgttatggaaaacaggctttgctccttagccttactctcccttaaagaattcaagttgcagcttgatttgggagttagatattgctaaattttatttaaataaattatgttatttaccctttcttgtaaatgtcttctttctctttaattatccagaatatcacttagattcattaagttcttctgcctaattacaccactgttttaagattttctttttgcattttactgtccccatttctctttctcccctgttctctttttatcctagttttctctgccatcttaaaagaactacaagaaagacagaaccttctgtgctggattcggaaaatgacatatgaattatgagtaatccttgttccttcttgcatcctaattctgaatctcagttcagttcacttcagtctctcagttatgtacgattctttgcaatcccatggactgcagcataccaggctcccctgtccatcaccaactcctggagcttgcttaaattcatgtccatcgagttggtgatgccattcaaccatttcatcctctgtcgtccccttcctctgctttcaatctttcccagcatcagggtcttttccagtgagtccgttcttcacatcaagtggccaaagtgttgaagtttcagcttcagcatcggtccttccaataaatattcaggacttatttcctttaggtttgactggtttcatctccttgcaccccaaggtactctcgagagtcttctccaacatcgcaatccgatggcatcaattctttggcagtcagctttctttatgatccaactctcacatccatacatggctactggaaaaaccatagctttgactagatggaactttgtcggccaagcaatgtctctgctttttaataagctgtctagctttttatagacagcttattatagcttgttatagcttttcttccaaggagcaagcatcttttaatttcatgtctgcagtcaccatatgcagtgactttggaggccaggaaaataaagtctgtcactatttccactgcttccatctctttgcaatcaagtgatgggaccggatgccatggtcttcattttttgactgttgagttttaagacagctttttaattctcttctttcactttcatgaagaggctgtttagttcctctttggtgtctgccataagggtgggtgtcatctgtatatatgaagttattgatatttctcctggcaaccttgattccagcttgtgcttcatccagccctgcatttctcatgatgtactctgcatagaagttaaataatcgaggtgacaatacgcagctttgacctatttctttccctgttctgaatccagttggggagatgctgaaagtaacacatctaacaagtgactgtaaatgagtgtattcaaggtttttatgagatcagataatgaagcccttggtatgaaatgggtagtaaagataagtagtacagacaattgtccaaaagacaagaagacaaaagtcagaaaagcaaaggatagcataggccaaatcactgatgaataatgtgtttgtgtattctgagaatttcaggtaaacagaaaaacaaatgaagcaaaactgcctgggatagaatagaatagatactatattttggtgtacactgtggacacattcttaaagttaaaaattcaccaagaagattccatctagacattactcacaagatatttgcactggtaatcagccacagaatgaggtgtccataggcattaaggaaagtggtagaaaagaagcacccagcgtagctcgggttagtgaaccgaggcacttcatgctgcatatttgtattgcacgtttcagtgtacatcgtgtttcacttcctatatctcgttggacacttcagtttgccatatgatatgtccagggggttcaggcacggaggaagggcctcggaagacctcggggggagaggggcaggcactgctgtgtattgatggggggattgtttgcactggttgatgatctctgaacaaccaagaagtacacaaggatctacctaactggacgtgctaagtaatttcactttggggattattctccagggagacgatccattgatagagaagtgaaaagcatcgagatgtgtctagtagttgtaggaagtctggggtgctttcctgatggggtgccctcagctggaaatagcccctccttcctttgacctgtcctgtggctatttgcagacattttattcctcttaccagactgtaagctctttgaggctggatttctgccttttgtctattcattcattcactcattcttctattcatgcattcaccaattccacaagtagttgttgcctgtaacatgtgccagagattgtaccaggcagatgggcatatctagataagcaaaagacatgatcctttctcttctggagctaacaatctactgggggcagagataatagcaaacaagtaaatatataatggttaaatagaaatttcgaatttggaacattctcatgaggaaaacagctaagatatggagggagagaagaagccagaaggtgacgggacgaggcagctggcacagccctaggcccaggaattcaacaggcatctactgagtggacccaacgcatgagaggacagtgccaagcaagcaactcaaatgtcccaccggttgggcatggccaggtagcctatgctgtgtctggacgtcctcctgctggtatagttattttaaaatcagaaggacagggaagggagcagtggttcacgcctgtaatcccagcaatttgggaggccaaggtgggtagatcacctgagattaggagttggagaccagcctggccaatatggtgaaaccccgtctctaccaaaaaaacaaaaattagctgagcctggtcatgcatgcctggaatcccaacaactcgggaggctgaggcaggagaatcgcttgaacccaggaggcggagattgcagtgagccaagattgtgccactgcactccagcttggttcccaatagaccccgcaggccctacaggttgtcttcccaacttgccccttgctccataccacccccctccaccccataatattatagaaggacacctagtcagacaaaatgatgcaacttaattttattaggacaaggctggtgggcactggagtggcaacttccagggccaggagaggcactggggaggggtcacagggatgccacccgggcagtcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcatagggtcattaattgtaaaggaaaggtgccgacctccggtcacctattcaggcatagaagctttttaaaccgagcgcttttatagaagccccagtccccttctcagatcccgagtgtcgcgtgttacctcggggtacctgaagggcatccttagcctgtcaccagtgtgtgggtaccagtttcaatgtcactttaaagtgggtttcgcagtaaagtcgccgtgctggggttgcacacatgacgggcccgtgtgggcgtggcttttggccccgtgggtccttgttaccaaggaggagttcccacggccgtcatgctccgctacgaagcaacagtgctgttactaacactcgccagtggatcgagcgtggagccaaacacagtacaaagtgttacccctctagacctggaaagaccaggcggagtttcaagttgcacgttttgtgtcagttggggaaacctgcttattaacatcgccgtccacctgtgcacaggaagatgcctacagccacaccagcaatgatgaaactgcccaccaggacgcccaggaccagcgaagtgtaggagcggcttgtttggctccctttcgtgttttccgcggaaatatgtttctgcacatactgcacacaggtgtcctccaggaattcccgcagttcataccgagtgcggttgtaggcattgagctgctgcagggtgaaggtgaccactccggaggtgacctgggtgtctgcctgccacaaggctctctccggccggaaactcacaaaggagctcccattcacagccacttcgaagaagacatgggctctagagccctcgggaggcagctcacagcccaggaagcagcggatggtcagaggaaaggccaaggtccgctcctggtgcaccaggcgcacgaggccgtggaactggagcaggtaggactgcaggccactctgcgtgcgcgcccagctctcgggctcctgcaagggctgcagctgaatgatcgtggtgttggtgtctgggccttccagcacgtgcgttaggtgtccccccagcgacgcgttgccctggtaccacacgtgataggggtcgcggaagtaggagatctggagcatatgaagtctttggaggccatctgaggcgtcttggctacaaaaggcccagccagacagcagcagtatcggcagcaatgttgtcaacataggtccagggttctcctccacgtctccagcctgcttcagcaggctgaagttagtagctccgcttccgttattcctaggaggttgtatagtcttctgattggaagccacaaatttcatataaactagtccaagtaattgtgctagagctaagatactcaaacctgaaatcagaagagggccatgcattggtatacacgccgcaatacagagactcagtccaaccacagcgaggatataggctatcacctgaataaccaatatggcaatgacgaaggaggttaatccaatcgctgtactaaacacatagtagtgaagtaatattaatatccctgtagaagtcacaattaaaccaaggccagtagcattctttaatgaatattcacctgggacgaaaagaatggctccaacaatgacaatgacagtgatcactagtccagcaacaagtaaagcaattgttttctcatccataccaccggatctatatttaagtgttttaataccaaactgtccccagaacaggagtatagcaaaaattgggaaaataacaataagaatattttcatttggagaaaaccatgaaacaacacgatattttagctcgatgatcgtttcaccttctctggttaattctgttacttcacaagtgtagtttcctgtgtgtgagacagcatcactcttatccatcttcaaagaggcatctccttttagtaattgtgagacttcaatttttgcactactaaagtcagtggggacagtggacttgtttagagctccatcaaaggtgtaaatatctcttcctttaaatttccactttacgtatacttcagtagtgttttgtgcctccatattagtaacaaagcatggaatgacgacagtgtcattacaaaacgtgaattctacagattttgttttattaaatagtagctgagctgatccgcagcacgccgagcccagcaacagcgccgctaccaggggccacatggtggctgtctgttacaacacaaaaacaacaggaaaaaaaaaagcccaaagttcagcaagaaattcacaggccaatatatacccagtgctaaataattcattatcactttgtagtagccaaataactgacgtgcctaaaaacctcacaggcttgacaattaacctcaaatccaacgtctcaggcgtttaagaaagcaaaacatggaaacctgacccaggtaaattcgcggacctacttatcctccccctcaatggatgtctgtcctctgtcaacacggcagcgtttaccccaggcccaaaccctgtgtccccaaactactaaacatcttcctacacacatagcggcaggtggccccaccctaggctatgagcccacaaaaaggggtgaggcctcgtcacggtcgtggatcgcaagtcccctgccccagaagcgttcaggccaactcagcggcaccagcagttagtgtcccttcacagggacggaaaaccgaagttctcgccgcgcgccagccagccagtcgagccggaaagcaatgacctagcattcgatccccgaaacactgcacaaccccgttccacaaacggccgggccccgccatcaatggaagcctccgcgcctctcgtttccgtttcacccagtgctcctcgcccgcccccaatttctctctcccacctcagagcccgcttcagaggccggcttctcccacagagagattgggaacggccgccattttgctctaggtggccgttcgtcttaaggctattccgcacgagggccccgggtgactaagcagctcggctgcccttccgccgcggcgggcaagcagacctcccgcacccacccccgcagccgcaagacccccggacgtccgcctcaccaggtggcagtggcaacagcggtcacagaagaaacgcaggcaaactcccggcctccacgaaactgcctgcgccacacccggtgcttccttatatagccatcggtagcaccgccccagtagattcctccgcagaaacgccgagaagggactacttttcgcggcccttcctgccctctgaagagagaagcagtccccccagaatcttctaatttcactcctagaatgctttcctgtgaagactcgaacactggggctgattttgggggggggggacgaggccttagtcctgagcggccgagcggagggatcagcgtgttcgctgaacactgcgtccgcggacagggccggtactcggctggttggggggggtgtgggggaggtgccgcggaaggtgcgaaaacccgacacggagtcctctgagcgtccggagggggctgtccccgctgccggtccccggcgccccctcccctcaaccaggaaggctcgcctttcctgagacccgccctcggctaacaggggtcccgccgagcgcctcacgatgaatcggggtcccgctcccctggcccgagttccgccgtgcccctccccccaacccctcttccccgccagcgaaaccgtggggtctttattctgggtctcccataggtaacgatagtgtttctgtttccataaacttcccctcacccccagtgggtcgcgaggacttcccggggggtctagtcaccccaactgtggcggccgaacccatccccctgcgggcgggcaccgggacaagaggaatgactcgacaaatctcggggccgggcctcaagcccgcctcaggagggtcgtcaggacctgcaggaattttctcacaacgcaggagtgaaaaataagtgtccaaaggagaaatgcctgtgacaagttcacattgaattttgaaaagtaaaagcaaaaattccacacagctgtgaaacactccttgcgctggacctgaaagctgacagaactttgcggattgctcttcggccttcctgttttgttcccgattatgagcaagaaggcatcagaatttcacttctgctgccatttgaactcagaaatcagaaatcaaatctatttaaacccacgttttctttttttcttttttttaattttattttttaatgaagttttttattgtagttgatttataatgtcaatttctgctttacagcaaaatgatagtcatgcatatatatacatttcctttcttatcgctgagcctgagatttttaaaaggacactaattgtaagttctgtatagtcctggtggaaaaaagaccccaagtatgaaatttaaatctatagacaaattccatttggataaaagaaaaagatcaccagtcagatctttttcattttgatattttattttgtgatctctgtgtcatttctccagcatattttttccttttttcaaaaagcatacttaaatttttttccaaaggcatattttaaaaatgttttaaaatatatgaacgtgatgaaaacttaaaacaggttttctatagtttataatgaaaaacctccctcatgcactcaattccctagccactgttctttctagactcttctagaaatattctctatttctataaatgtggggagggtgtttttaatttttacccttgaagctttcaataaatatatagaaaaagagagaaccgactaaaaaataccctgctattaggaaaagactacattcctgttggaattataaacattatgttatttaaatactgtacttaaaatgagaataaaaacaaaactatgttttctttggcaacctgtgtctgtaggtatttatgggaaaggtctaagcagtattcaaaacagactttaactcctatcgttttaaacattttcaaagagaatgaattcattaccaagaaatgtaaatgaataataaaaataaaatgtcatttttcagtttagcaggagacctcagtgacttccagtagagatttctgtgagggatatttctaaatttctgaaaagagggtttaaaggaacagaacatcaaagctctgtataaggtttccttcttgaattccagaaagaagttttcagaggaacaaaaagctgaggttctttctcaggtgactaggcctggcttcaaaccacaccctgttttcttttggctgttctttcactgcaggtcttatgattcatgttgtttaaaggctgagtcacgagctttgtgacatagcttttttttcaagagtccaaaaactacagagaaaaacagacctgatttcagaggcaagggaaggtgaaaaggagaaagagggggagagggggaagaagaaaggctccaagggtgaggactgggtcccagggctatctccaaagagaaaacaatattcttaggcgctaacaacactgatgttgtctctagcaggaaaattctctactagagaattttggtctctaagtccaacagtgggttttgttgaagcaaatagaaataaacatttgtccaagggcactgaagtgaaagggaggagggggaagtaaactctcagggaggtagatgctgtttctctagagcagtggttctcaaccaggagcgacttggtcccttggtggacacttggcagtatctggagacatttttgcttgtcacagctgtggtgttggggttgaggtgtgccgctaaaatctagtggtagaggccagggatgttactaaacatcctgcagtggccagtcccccacaaaaacagaattacccagcccccaaagtcagcaatgcaatgggttgacaaattctgctctacggaggatttttgttgtttttgttagagctgcttttctgtttgctgagaagggctcccaaagtctaaatgtcccacttggattcggggatcgtgtaccaagtcacgttcctacaacctaaaatcccttgacctagaatgcaatgtgctagaatatgccagaagcaggatgagtcattggatccattttcagttccttccacccactgatccatcctttgcaggtgccccagaagggatggcttcagagctggcaccaatggaagagtgacagaggcccagcaacacggcaggattggcgggcaggcaagagcacgtgatgggctgagctcacaaagggcctgggtgttgggctgttggggattggactggagcctacctgtctgcctttcctcctttccccaaaggattcagctctcctgaaggtcaccaccttgtatgggacttaactcagcgtcatgagagtgtctacgtagtgaccagcaaacattttctttccaagagaaagggtgaaatctgagagctggacgggaaaggtttgacttgcgtcatcatcagttatataaccataaaagggaatctgcagcttaggagagaaaaaataaaaagaagccctagggactctactctgtccgttttcctgcttacatttatgtatttgcattctgtggcagaacacaaactgctccagcgagttcactcagactcacgtccatcgagtccgtgatgccatccagccatctcatcctctgtcgtccccttctcctcctgcccccaatccctcccagcatcagagtcttttccaatgagtcaactcttcgcatgaggtggccaaagtactggagtttcagctttagcatcattccttccaaagaaatcccagggctgatctccttcagaatagactggttggatctccttgcagttcaagggactctcaagagtcttctccatcaccacagttcaaaagcatcaattcttcggtgctcagccttcttcacagtccaactctcacatccatacatgaccacaggaaaaaccatagccttgactagatggacctttgttggcaaagtaatgtctctgcttttgaatatgctatctaggttggtcataactttccttccaaggagtgagcgtctttgaatttcatggctgcagtcaccatctgcagtgattttggagcccaaaaaaataaagtctgacactgtttccactgtttccccatctatttcccatgaagtgatggggccggatgccatgatcttcgttttctgaatgttgagctttaagccaactttttcactcttcactttcactttcatcaagaggcttttgagttcctcttcactttctgccgtaagggtggtgtcatctgcatatctgaggttattgatatttctcccggcaatcttgattccagcttgtgtttcttccagtccagcgtttctcatgatgtactctgcatagaagttaaataaacagggtgacaatatacagccttgatgtactccttttcctatttggaaccagtctgttgttccatgtcctgttctaactgttgcttcctgacctgcatacaaatttctcaagaggcagatcaggtggtctggtattcgcatctctttcagaattttccacagtttattgtgatccacacagtcaaaggctttggcatagtcaataaagcagaaatagatgtttttctggaactctcttgctttttccatgatccagcggatattggcaatttgatctctggttcttctgccttttctaaaaccagcttgaacatcaggaagttcatggttcacatattgctgaagcctggcttggataattttaagcattactttactagcatgtgagatgagtgcaatttcaagtaatagataatagtatttgtgctcaatacatcaacttctaaaagaccttgagatttacaaataattctaaagtcaaatggggacattacagggatattgatttcagctgaatgtaagcgatactttattgaaacttgaggggtttaatagaataaattgccttgtgaatagtgattcccttgacaccagtgctacacgagtgagtatgacctgtgagagatactatagcgtaagaatcctaaattagaagaaattaggatgaccttgaggaggccctgtgcatacatgctaagtcacttcagtcatgtccgacttccagacccagggatcaaatccatgtcttctgtggctcctgcattgcaggtggattctttaccactgagccacctgggaagcccctgtggggccctcctaaatccaaaattccatgatttttatttatttattttggctgcactgggtcttggttgtagcatgtgggatctttttagctgcagcatgtgggatctagttccctgaccagggatcaaacccaggccccctgcatttggagcttggggtcttagccactgcaccatgaaggaactcccccaaagtccatgattttaaagtcagacaattaaagattgacctgaagcagagggatggtttctgagctaagaaatggagctccagggttctgattattccaactttcaaccactccccaagtatatttacattaactactaaatgtaagatatcccaagtgaatacacatgtgtgccatttggaataacattcattacagcatctaagaacttcctaaaagcttttaaggaagatttgctgattattttcattgtaaaagaattattgattttgtaacatcatgttttacaaatatggatagaaataacaaaacataagagaaaaaaaacagagagataaattaatctgcaattttagtcggagattttaaaactcatttttcagtacttaagggtgtaaataggcttcctccccaaaaatcatctttgttgttaatttcttaattttcattagaggacatcctccatattaattcaatattgttaaatgctttgatacttgttttctgtttctgaaatacttggaaattaagcaacataattctaaattgccatagttaaagaagaaatcccaaagaaatttggaaaatatttgaactcgaggataatgaaatcacaaaatatcaaaatttgtagcatgtagctaaagcactgattaaaagaaaacttatacctttaaatcttatatttgaaaagaataaagctctaaagtagtaatctaaaaatccacttaaagaatataggcttttaaagacaaaaacttaaagtgagtagtaaagtagaaataataaagttatgagcaaaatttaacagacaatagagttactttgaacactaagcattgatttatagatcactagttacttagccaaggtgcttgggtgactaaaaacaactttaaaactgccctttgaagtgcatttagaaagaaaaagaaacgttcaagccgccattagggaagcagagtgtgatttaattcctttggaaaaacacagagcaccccacagttccatgcaaaaatagctgaagcttctcgcgtgctgtaatgtgtcaataactttagaaacctcatttcatttactcctcacccaagccttatgaggcaatattattatctctattttgtaggtgagcaaactgggtctcggggaggttaagtaatttcttcctgagcataagttcaagtccaggtccttctgattctttcccttattccaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagctttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactatcacatggcataaagccccatggcgaccgttgccaccagaaagctgagtgtcaggacccatcggatgagcggcacctgggagaggacgctgagctgcggcttccccctgggggttgtcacgggagtggagtcttgcacccggctgccggccctcttgcggatgtcggatgcctgcgagggtctctggtccttagtgtcctgggtcagcagctcctgcacctcctcaaacagctgaatgttgagcaggaaggcggtcttggcttcttcgaggaccctctgcttgacctcgggggtcatctccagagtgttcattcgggagcggtacagctgcttgaacttggtggcgttggcgacattggggaaagtgaagaaggccaggccctccccggagctgggcaggtccagggccttctgagcaatcttcttgaggacctggcccccagacaggtcacccatgtagcgggtgtaggcgtgggccaccagcagctcgggctcgaagcgccccacctgctgcagtcgccgcacgtagcgcttggtggcctgcgtgtaggggatggcctcctgccagcggggcccataccagaaggccatgtcctgctccagggcggcccggcggtgcagctcttccgggaagtagaggggcgtgtagaccgggttctccttgttgtgctcaatctcctcctccagggcatcgtagatgtggtacaaggacgccatcaccagcttaaagccttctcgggtgacctcgcccttctgaaagttcttcatgaactcggcattctcagcctggacgtgcacctccttggtggcctccttcagggcctctgacaaatcctggggcatgctgttgggctgtgagtgctccataggcccggggttctcctcgacgtcaccggcctgtttcagtagtgagaaattggtggcgccgctgccgccatacatctgcttgaattgaaagcactcattgcagtagccgttacacttggcattgccgaaatggtcgcaggcgggggcccggcagcgctgcgtcgggggatcctctgggacgggctctggccgccgggcgccagggctcactcgttggccaaggggctggcactctatgcacagctcctggctgcagcaggccagcacgttcctgcaggtggcccgggcgcacttggacctggaagcgctctgggtggctcgcgacaagtctctgcgctggctcagcctcagctgctcttcagtcctttttgcttcatgaaatctctgattctgagcctcaatgaaacacttctgacagtatccttcaaacaccgtgcttccgagggcgccacattccctgcccaggcaggggacggcattctggaacctggaggccgtgggactggctttccccgaggcagtgacgaaatgtttattttctctgtactcaatgaaacacagcgtgcaaaagcctttgttttccggagtcccaaagtacatgcagccggcttttctgcacttgctcgtccccgtcctgtcccccggagtccgtgcggccgaggcggagcagccagagggagcctcaggcccggctctgcggcaggggtgtggggagacgctctgggccagttgcgaggggtcggacttggagcgctggtggcaggatagggggatgctggagccgaggctggaggcgggctcagccgtagtccttttaaagcaagtgctgcagatcccgttaaacgtcctggtgacgttctggaggcaggcttggcacttgctggggtcgagatggcgcgtggggtccggggggtggccggggttgagctgccgggcgttgtggcatcgctcgcagaagccgttgtgctgcacgttgagcgtgaaggggcagccggggctcctgcacttcatggccgtagtctcgctgaacaggaagaggctgggagccgtcggaggggctgagcgggggcccccagagggctcctcggggttccaggcctccccgcgggaggctccaagcgccaggccgggcagcgcctcggggtccggcttggaggtgggctttgggggtttgctttggttcttctgccgtctctctgagcactcgtggcacaagggctgggtgttcaccgacatgaagaaagggcagttgggcgtctcgcacttgatgtccatgagagaaagctggggcacggaaggctccagagggttctgagggtgcgtggctctccgcccctgctcattgttttcctgccacttcttgtactcatgctggacaagttcgaagtaatcgtctaccaggtttatttctttgggtaagttagcttcatccaactttgcagcattaattagatgggtggtgccatggtcccagccttgaacggggatttctatcaccgtcaagtactctttcaggagcttttccttcatctcattttcgggatctgtcaagaagtgaacttttaagtcttcgaatcttcctcgctctctgttaacaagtggaatagctcggatttctggcccactgtccttcagggtcaccagggggacaaagtgttggctgtcgtagccgagaacgatagggtatctgtagcattcctgggcgggccaatgcagaggcaagtaaattccgcccaccttcagaggagcgaaattagaacccgattccaaacttctcagcatcttgtctgaaatgacgatgattggcctcctgaggatgttgcaaaggacgaatatgtgtatttcttccagtgaattatactgaagtccacttcgggccactggtgtgtccgtggatgccattttgataaggttgtcccattcctcagtccaattccgggtgtcatagcaaagccccgtttccacgaattcctgagatttaagggactccagctgccagcgaaatttgaagttgcgtgtgtccgtctccttgagggtgctgaagagcgccttcctcagcaccaagtctgtgtcctgaacaccccacatgtactgggaagcagcatgcatgaggcagttcccgtccccattcgttttcagtgccacaagcttcctcacttctcgacaccagttgagcttcttctggctttccagggaggcctggatgttcctgtcgatgagagctttgtggatgatctcccgaaattgcggacaaaactggcaggttctgaacatttccagagtgtatcggtgcatggatttaaaatggtgaatgattccattggtaggtttgaaaatatcttctggagttctctctcttatcttcacagccttccgcatgttgctcaaatacaaagccaggggaaggagttgctcagccatggtggcggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatggggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgttaagtgccgcggtcgtcggcgcctccgccctcccccttgggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagcccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggctgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcc

SEQ ID NO: 228 - DNA, 29454 bp, synthetic construct
  misc_feature 1..29454: note = 15S6
  source 1..29454: mol_type = other DNA
taagctccctttcctgctttccaggaaaggttttttcatcctcagagcccaaagattgaatatggaaaaattatgaagtgttttgagcatctggcctctgcctaataaagacatttattttcattgcactggtgtatttaaattatttcactgtctcttactcagatgggcacatgggagggcaaaacactgaagacataaagaaatgaagggctagtcgagaccttgagaaaatatatcagtatcttggaccccatgacagcagtggttgtaaatagctgatgttatggaaaacaggctttgctccttagccttactctcccttaaagaattcaagttgcagcttgatttgggagttagatattgctaaattttatttaaataaattatgttatttaccctttcttgtaaatgtcttctttctctttaattatccagaatatcacttagattcattaagttcttctgcctaattacaccactgttttaagattttctttttgcattttactgtccccatttctctttctcccctgttctctttttatcctagttttctctgccatcttaaaagaactacaagaaagacagaaccttctgtgctggattcggaaaatgacatatgaattatgagtaatccttgttccttcttgcatcctaattctgaatctcagttcagttcacttcagtctctcagttatgtacgattctttgcaatcccatggactgcagcataccaggctcccctgtccatcaccaactcctggagcttgcttaaattcatgtccatcgagttggtgatgccattcaaccatttcatcctctgtcgtccccttcctctgctttcaatctttcccagcatcagggtcttttccagtgagtccgttcttcacatcaagtggccaaagtgttgaagtttcagcttcagcatcggtccttccaataaatattcaggacttatttcctttaggtttgactggtttcatctccttgcaccccaaggtactctcgagagtcttctccaacatcgcaatccgatggcatcaattctttggcagtcagctttctttatgatccaactctcacatccatacatggctactggaaaaaccatagctttgactagatggaactttgtcggccaagcaatgtctctgctttttaataagctgtctagctttttatagacagcttattatagcttgttatagcttttcttccaaggagcaagcatcttttaatttcatgtctgcagtcaccatatgcagtgactttggaggccaggaaaataaagtctgtcactatttccactgcttccatctctttgcaatcaagtgatgggaccggatgccatggtcttcattttttgactgttgagttttaagacagctttttaattctcttctttcactttcatgaagaggctgtttagttcctctttggtgtctgccataagggtgggtgtcatctgtatatatgaagttattgatatttctcctggcaaccttgattccagcttgtgcttcatccagccctgcatttctcatgatgtactctgcatagaagttaaataatcgaggtgacaatacgcagctttgacctatttctttccctgttctgaatccagttggggagatgctgaaagtaacacatctaacaagtgactgtaaatgagtgtattcaaggtttttatgagatcagataatgaagcccttggtatgaaatgggtagtaaagataagtagtacagacaattgtccaaaagacaagaagacaaaagtcagaaaagcaaaggatagcataggccaaatcactgatgaataatgtgtttgtgtattctgagaatttcaggtaaacagaaaaacaaatgaagcaaaactgcctgggatagaatagaatagatactatattttggtgtacactgtggacacattcttaaagttaaaaattcaccaagaagattccatctagacattactcacaagatatttgcactggtaatcagccacagaatgaggtgtccataggcattaaggaaagtggtagaaaagaagcacccagcgtagctcgggttagtgaaccgaggcacttcatgctgcatatttgtattgcacgtttcagtgtacatcgtgtttcacttcctatatctcgttggacacttcagtttgccatatgatatgtccagggggttcaggcacggaggaagggcctcggaagacctcggggggagaggggcaggcactgctgtgtattgatggggggattgtttgcactggttgatgatctctgaacaaccaagaagtacacaaggatctacctaactggacgtgctaagtaatttcactttggggattattctccagggagacgatccattgatagagaagtgaaaagcatcgagatgtgtctagtagttgtaggaagtctggggtgctttcctgatggggtgccctcagctggaaatagcccctccttcctttgacctgtcctgtggctatttgcagacattttattcctcttaccagactgtaagctctttgaggctggatttctgccttttgtctattcattcattcactcattcttctattcatgcattcaccaattccacaagtagttgttgcctgtaacatgtgccagagattgtaccaggcagatgggcatatctagataagcaaaagacatgatcctttctcttctggagctaacaatctactgggggcagagataatagcaaacaagtaaatatataatggttaaatagaaatttcgaatttggaacattctcatgaggaaaacagctaagatatggagggagagaagaagccagaaggtgacgggacgaggcagctggcacagccctaggcccaggaattcaacaggcatctactgagtggacccaacgcatgagaggacagtgccaagcaagcaactcaaatgtcccaccggttgggcatggccaggtagcctatgctgtgtctggacgtcctcctgctggtatagttattttaaaatcagaaggacagggaagggagcagtggttcacgcctgtaatcccagcaatttgggaggccaaggtgggtagatcacctgagattaggagttggagaccagcctggccaatatggtgaaaccccgtctctaccaaaaaaacaaaaattagctgagcctggtcatgcatgcctggaatcccaacaactcgggaggctgaggcaggagaatcgcttgaacccaggaggcggagattgcagtgagccaagattgtgccactgcactccagcttggttcccaatagaccccgcaggccctacaggttgtcttcccaacttgccccttgctccataccacccccctccaccccataatattatagaaggacacctagtcagacaaaatgatgcaacttaattttattaggacaaggctggtgggcactggagtggcaacttccagggccaggagaggcactggggaggggtcacagggatgccacccgggcagtcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcatagggtcattaattgtaaaggaaaggtgccgacctccggtcacctattcaggcatagaagctttttaaaccgagcgcttttatagaagccccagtccccttctcagatcccgagtgtcgcgtgttacctcggggtacctgaagggcatccttagcctgtcaccagtgtgtgggtaccagtttcaatgtcactttaaagtgggtttcgcagtaaagtcgccgtgctggggttgcacacatgacgggcccgtgtgggcgtggcttttggccccgtgggtccttgttaccaaggaggagttcccacggccgtcatgctccgctacgaagcaacagtgctgttactaacactcgccagtggatcgagcgtggagccaaacacagtacaaagtgttacccctctagacctggaaagaccaggcggagtttcaagttgcacgttttgtgtcagttggggaaacctgcttattaacatcgccgtccacctgtgcacaggaagatgcctacagccacaccagcaatgatgaaactgcccaccaggacgcccaggaccagcgaagtgtaggagcggcttgtttggctccctttcgtgttttccgcggaaatatgtttctgcacatactgcacacaggtgtcctccaggaattcccgcagttcataccgagtgcggttgtaggcattgagctgctgcagggtgaaggtgaccactccggaggtgacctgggtgtctgcctgccacaaggctctctccggccggaaactcacaaaggagctcccattcacagccacttcgaagaagacatgggctctagagccctcgggaggcagctcacagcccaggaagcagcggatggtcagaggaaaggccaaggtccgctcctggtgcaccaggcgcacgaggccgtggaactggagcaggtaggactgcaggccactctgcgtgcgcgcccagctctcgggctcctgcaagggctgcagctgaatgatcgtggtgttggtgtctgggccttccagcacgtgcgttaggtgtccccccagcgacgcgttgccctggtaccacacgtgataggggtcgcggaagtaggagatctggagcatatgaagtctttggaggccatctgaggcgtcttggctacaaaaggcccagccagacagcagcagtatcggcagcaatgttgtcaacataggtccagggttctcctccacgtctccagcctgcttcagcaggctgaagttagtagctccgcttccgttattcctaggaggttgtatagtcttctgattggaagccacaaatttcatataaactagtccaagtaattgtgctagagctaagatactcaaacctgaaatcagaagagggccatgcattggtatacacgccgcaatacagagactcagtccaaccacagcgaggatataggctatcacctgaataaccaatatggcaatgacgaaggaggttaatccaatcgctgtactaaacacatagtagtgaagtaatattaatatccctgtagaagtcacaattaaaccaaggccagtagcattctttaatgaatattcacctgggacgaaaagaatggctccaacaatgacaatgacagtgatcactagtccagcaacaagtaaagcaattgttttctcatccataccaccggatctatatttaagtgttttaataccaaactgtccccagaacaggagtatagcaaaaattgggaaaataacaataagaatattttcatttggagaaaaccatgaaacaacacgatattttagctcgatgatcgtttcaccttctctggttaattctgttacttcacaagtgtagtttcctgtgtgtgagacagcatcactcttatccatcttcaaagaggcatctccttttagtaattgtgagacttcaatttttgcactactaaagtcagtggggacagtggacttgtttagagctccatcaaaggtgtaaatatctcttcctttaaatttccactttacgtatacttcagtagtgttttgtgcctccatattagtaacaaagcatggaatgacgacagtgtcattacaaaacgtgaattctacagattttgttttattaaatagtagctgagctgatccgcagcacgccgagcccagcaacagcgccgctaccaggggccacatggtggctgtctgttacaacacaaaaacaacaggaaaaaaaaaagcccaaagttcagcaagaaattcacaggccaatatatacccagtgctaaataattcattatcactttgtagtagccaaataactgacgtgcctaaaaacctcacaggcttgacaattaacctcaaatccaacgtctcaggcgtttaagaaagcaaaacatggaaacctgacccaggtaaattcgcggacctacttatcctccccctcaatggatgtctgtcctctgtcaacacggcagcgtttaccccaggcccaaaccctgtgtccccaaactactaaacatcttcctacacacatagcggcaggtggccccaccctaggctatgagcccacaaaaaggggtgaggcctcgtcacggtcgtggatcgcaagtcccctgccccagaagcgttcaggccaactcagcggcaccagcagttagtgtcccttcacagggacggaaaaccgaagttctcgccgcgcgccagccagccagtcgagccggaaagcaatgacctagcattcgatccccgaaacactgcacaaccccgttccacaaacggccgggccccgccatcaatggaagcctccgcgcctctcgtttccgtttcacccagtgctcctcgcccgcccccaatttctctctcccacctcagagcccgcttcagaggccggcttctcccacagagagattgggaacggccgccattttgctctaggtggccgttcgtcttaaggctattccgcacgagggccccgggtgactaagcagctcggctgcccttccgccgcggcgggcaagcagacctcccgcacccacccccgcagccgcaagacccccggacgtccgcctcaccaggtggcagtggcaacagcggtcacagaagaaacgcaggcaaactcccggcctccacgaaactgcctgcgccacacccggtgcttccttatatagccatcggtagcaccgccccagtagattcctccgcagaaacgccgagaagggactacttttcgcggcccttcctgccctctgaagagagaagcagtccccccagaatcttctaatttcactcctagaatgctttcctgtgaagactcgaacactggggctgattttgggggggggggacgaggccttagtcctgagcggccgagcggagggatcagcgtgttcgctgaacactgcgtccgcggacagggccggtactcggctggttggggggggtgtgggggaggtgccgcggaaggtgcgaaaacccgacacggagtcctctgagcgtccggagggggctgtccccgctgccggtccccggcgccccctcccctcaaccaggaaggctcgcctttcctgagacccgccctcggctaacaggggtcccgccgagcgcctcacgatgaatcggggtcccgctcccctggcccgagttccgccgtgcccctccccccaacccctcttccccgccagcgaaaccgtggggtctttattctgggtctcccataggtaacgatagtgtttctgtttccataaacttcccctcacccccagtgggtcgcgaggacttcccggggggtctagtcaccccaactgtggcggccgaacccatccccctgcgggcgggcaccgggacaagaggaatgactcgacaaatctcggggccgggcctcaagcccgcctcaggagggtcgtcaggacctgcaggaattttctcacaacgcaggagtgaaaaataagtgtccaaaggagaaatgcctgtgacaagttcacattgaattttgaaaagtaaaagcaaaaattccacacagctgtgaaacactccttgcgctggacctgaaagctgacagaactttgcggattgctcttcggccttcctgttttgttcccgattatgagcaagaaggcatcagaatttcacttctgctgccatttgaactcagaaatcagaaatcaaatctatttaaacccacgttttctttttttcttttttttaattttattttttaatgaagttttttattgtagttgatttataatgtcaatttctgctttacagcaaaatgatagtcatgcatatatatacatttcctttcttatcgctgagcctgagatttttaaaaggacactaattgtaagttctgtatagtcctggtggaaaaaagaccccaagtatgaaatttaaatctatagacaaattccatttggataaaagaaaaagatcaccagtcagatctttttcattttgatattttattttgtgatctctgtgtcatttctccagcatattttttccttttttcaaaaagcatacttaaatttttttccaaaggcatattttaaaaatgttttaaaatatatgaacgtgatgaaaacttaaaacaggttttctatagtttataatgaaaaacctccctcatgcactcaattccctagccactgttctttctagactcttctagaaatattctctatttctataaatgtggggagggtgtttttaatttttacccttgaagctttcaataaatatatagaaaaagagagaaccgactaaaaaataccctgctattaggaaaagactacattcctgttggaattataaacattatgttatttaaatactgtacttaaaatgagaataaaaacaaaactatgttttctttggcaacctgtgtctgtaggtatttatgggaaaggtctaagcagtattcaaaacagactttaactcctatcgttttaaacattttcaaagagaatgaattcattaccaagaaatgtaaatgaataataaaaataaaatgtcatttttcagtttagcaggagacctcagtgacttccagtagagatttctgtgagggatatttctaaatttctgaaaagagggtttaaaggaacagaacatcaaagctctgtataaggtttccttcttgaattccagaaagaagttttcagaggaacaaaaagctgaggttctttctcaggtgactaggcctggcttcaaaccacaccctgttttcttttggctgttctttcactgcaggtcttatgattcatgttgtttaaaggctgagtcacgagctttgtgacatagcttttttttcaagagtccaaaaactacagagaaaaacagacctgatttcagaggcaagggaaggtgaaaaggagaaagagggggagagggggaagaagaaaggctccaagggtgaggactgggtcccagggctatctccaaagagaaaacaatattcttaggcgctaacaacactgatgttgtctctagcaggaaaattctctactagagaattttggtctctaagtccaacagtgggttttgttgaagcaaatagaaataaacatttgtccaagggcactgaagtgaaagggaggagggggaagtaaactctcagggaggtagatgctgtttctctagagcagtggttctcaaccaggagcgacttggtcccttggtggacacttggcagtatctggagacatttttgcttgtcacagctgtggtgttggggttgaggtgtgccgctaaaatctagtggtagaggccagggatgttactaaacatcctgcagtggccagtcccccacaaaaacagaattacccagcccccaaagtcagcaatgcaatgggttgacaaattctgctctacggaggatttttgttgtttttgttagagctgcttttctgtttgctgagaagggctcccaaagtctaaatgtcccacttggattcggggatcgtgtaccaagtcacgttcctacaacctaaaatcccttgacctagaatgcaatgtgctagaatatgccagaagcaggatgagtcattggatccattttcagttccttccacccactgatccatcctttgcaggtgccccagaagggatggcttcagagctggcaccaatggaagagtgacagaggcccagcaacacggcaggattggcgggcaggcaagagcacgtgatgggctgagctcacaaagggcctgggtgttgggctgttggggattggactggagcctacctgtctgcctttcctcctttccccaaaggattcagctctcctgaaggtcaccaccttgtatgggacttaactcagcgtcatgagagtgtctacgtagtgaccagcaaacattttctttccaagagaaagggtgaaatctgagagctggacgggaaaggtttgacttgcgtcatcatcagttatataaccataaaagggaatctgcagcttaggagagaaaaaataaaaagaagccctagggactctactctgtccgttttcctgcttacatttatgtatttgcattctgtggcagaacacaaactgctccagcgagttcactcagactcacgtccatcgagtccgtgatgccatccagccatctcatcctctgtcgtccccttctcctcctgcccccaatccctcccagcatcagagtcttttccaatgagtcaactcttcgcatgaggtggccaaagtactggagtttcagctttagcatcattccttccaaagaaatcccagggctgatctccttcagaatagactggttggatctccttgcagttcaagggactctcaagagtcttctccatcaccacagttcaaaagcatcaattcttcggtgctcagccttcttcacagtccaactctcacatccatacatgaccacaggaaaaaccatagccttgactagatggacctttgttggcaaagtaatgtctctgcttttgaatatgctatctaggttggtcataactttccttccaaggagtgagcgtctttgaatttcatggctgcagtcaccatctgcagtgattttggagcccaaaaaaataaagtctgacactgtttccactgtttccccatctatttcccatgaagtgatggggccggatgccatgatcttcgttttctgaatgttgagctttaagccaactttttcactcttcactttcactttcatcaagaggcttttgagttcctcttcactttctgccgtaagggtggtgtcatctgcatatctgaggttattgatatttctcccggcaatcttgattccagcttgtgtttcttccagtccagcgtttctcatgatgtactctgcatagaagttaaataaacagggtgacaatatacagccttgatgtactccttttcctatttggaaccagtctgttgttccatgtcctgttctaactgttgcttcctgacctgcatacaaatttctcaagaggcagatcaggtggtctggtattcgcatctctttcagaattttccacagtttattgtgatccacacagtcaaaggctttggcatagtcaataaagcagaaatagatgtttttctggaactctcttgctttttccatgatccagcggatattggcaatttgatctctggttcttctgccttttctaaaaccagcttgaacatcaggaagttcatggttcacatattgctgaagcctggcttggataattttaagcattactttactagcatgtgagatgagtgcaatttcaagtaatagataatagtatttgtgctcaatacatcaacttctaaaagaccttgagatttacaaataattctaaagtcaaatggggacattacagggatattgatttcagctgaatgtaagcgatactttattgaaacttgaggggtttaatagaataaattgccttgtgaatagtgattcccttgacaccagtgctacacgagtgagtatgacctgtgagagatactatagcgtaagaatcctaaattagaagaaattaggatgaccttgaggaggccctgtgcatacatgctaagtcacttcagtcatgtccgacttccagacccagggatcaaatccatgtcttctgtggctcctgcattgcaggtggattctttaccactgagccacctgggaagcccctgtggggccctcctaaatccaaaattccatgatttttatttatttattttggctgcactgggtcttggttgtagcatgtgggatctttttagctgcagcatgtgggatctagttccctgaccagggatcaaacccaggccccctgcatttggagcttggggtcttagccactgcaccatgaaggaactcccccaaagtccatgattttaaagtcagacaattaaagattgacctgaagcagagggatggtttctgagctaagaaatggagctccagggttctgattattccaactttcaaccactccccaagtatatttacattaactactaaatgtaagatatcccaagtgaatacacatgtgtgccatttggaataacattcattacagcatctaagaacttcctaaaagcttttaaggaagatttgctgattattttcattgtaaaagaattattgattttgtaacatcatgttttacaaatatggatagaaataacaaaacataagagaaaaaaaacagagagataaattaatctgcaattttagtcggagattttaaaactcatttttcagtacttaagggtgtaaataggcttcctccccaaaaatcatctttgttgttaatttcttaattttcattagaggacatcctccatattaattcaatattgttaaatgctttgatacttgttttctgtttctgaaatacttggaaattaagcaacataattctaaattgccatagttaaagaagaaatcccaaagaaatttggaaaatatttgaactcgaggataatgaaatcacaaaatatcaaaatttgtagcatgtagctaaagcactgattaaaagaaaacttatacctttaaatcttatatttgaaaagaataaagctctaaagtagtaatctaaaaatccacttaaagaatataggcttttaaagacaaaaacttaaagtgagtagtaaagtagaaataataaagttatgagcaaaatttaacagacaatagagttactttgaacactaagcattgatttatagatcactagttacttagccaaggtgcttgggtgactaaaaacaactttaaaactgccctttgaagtgcatttagaaagaaaaagaaacgttcaagccgccattagggaagcagagtgtgatttaattcctttggaaaaacacagagcaccccacagttccatgcaaaaatagctgaagcttctcgcgtgctgtaatgtgtcaataactttagaaacctcatttcatttactcctcacccaagccttatgaggcaatattattatctctattttgtaggtgagcaaactgggtctcggggaggttaagtaatttcttcctgagcataagttcaagtccaggtccttctgattctttcccttattccaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagctttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactatcatttacccggagacagggagaggctcttctgcgtgtagtggttgtgcagagcctcatgcatcacggagcatgagaagacgttcccctgctgccacctgctcttgtccacggtgagcttgctgtagaggaagaaggagccgtcggagtccagcacgggaggcgtggtcttgtagttgttctccggctgcccattgctctcccactccacggcgatgtcgctgggatagaagcctttgaccaggcaggtcaggctgacctggttcttggtcagctcatcccgggatgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggggaagaggaagactgacgatccccccaggagttcaggtgctggggacggtggggatgtgtgagttttgtcagaagatttgggctcctgatcagaatctgggcacggttctggatcaattacataaatctgggttccgttgcctatgccctcgtagtatggcggtgggtacatgagctccaccttgcagatgtagagtcccgtgtccatggccctcagtccttggatagtgaggttcacttgatttccactggaggtgcccgtgcagatggaatcatctaggaaggtcaactcattccccatcatgtaggttgccgcacagacttcagtcacctggctgtcagcctgccgaagcactgtcacccggacctcagtatatttgcctggagatgcatactcacacacaaagctagcgatgcctcggctgctggccagtaccacagcaggctgggccacgtgcattgccatgctcgccatgcttggaaacaggagtgcaaggaccagactgagcagcgtcctctgtgtgagcagtacacccataggcccggggttctcctcgacgtcaccggcctgtttcagtagtgagaaattggtggcgccgctgccgccatacatctgcttgaattgaaagcactcattgcagtagccgttacacttggcattgccgaaatggtcgcaggcgggggcccggcagcgctgcgtcgggggatcctctgggacgggctctggccgccgggcgccagggctcactcgttggccaaggggctggcactctatgcacagctcctggctgcagcaggccagcacgttcctgcaggtggcccgggcgcacttggacctggaagcgctctgggtggctcgcgacaagtctctgcgctggctcagcctcagctgctcttcagtcctttttgcttcatgaaatctctgattctgagcctcaatgaaacacttctgacagtatccttcaaacaccgtgcttccgagggcgccacattccctgcccaggcaggggacggcattctggaacctggaggccgtgggactggctttccccgaggcagtgacgaaatgtttattttctctgtactcaatgaaacacagcgtgcaaaagcctttgttttccggagtcccaaagtacatgcagccggcttttctgcacttgctcgtccccgtcctgtcccccggagtccgtgcggccgaggcggagcagccagagggagcctcaggcccggctctgcggcaggggtgtggggagacgctctgggccagttgcgaggggtcggacttggagcgctggtggcaggatagggggatgctggagccgaggctggaggcgggctcagccgtagtccttttaaagcaagtgctgcagatcccgttaaacgtcctggtgacgttctggaggcaggcttggcacttgctggggtcgagatggcgcgtggggtccggggggtggccggggttgagctgccgggcgttgtggcatcgctcgcagaagccgttgtgctgcacgttgagcgtgaaggggcagccggggctcctgcacttcatggccgtagtctcgctgaacaggaagaggctgggagccgtcggaggggctgagcgggggcccccagagggctcctcggggttccaggcctccccgcgggaggctccaagcgccaggccgggcagcgcctcggggtccggcttggaggtgggctttgggggtttgctttggttcttctgccgtctctctgagcactcgtggcacaagggctgggtgttcaccgacatgaagaaagggcagttgggcgtctcgcacttgatgtccatgagagaaagctggggcacggaaggctccagagggttctgagggtgcgtggctctccgcccctgctcattgttttcctgccacttcttgtactcatgctggacaagttcgaagtaatcgtctaccaggtttatttctttgggtaagttagcttcatccaactttgcagcattaattagatgggtggtgccatggtcccagccttgaacggggatttctatcaccgtcaagtactctttcaggagcttttccttcatctcattttcgggatctgtcaagaagtgaacttttaagtcttcgaatcttcctcgctctctgttaacaagtggaatagctcggatttctggcccactgtccttcagggtcaccagggggacaaagtgttggctgtcgtagccgagaacgatagggtatctgtagcattcctgggcgggccaatgcagaggcaagtaaattccgcccaccttcagaggagcgaaattagaacccgattccaaacttctcagcatcttgtctgaaatgacgatgattggcctcctgaggatgttgcaaaggacgaatatgtgtatttcttccagtgaattatactgaagtccacttcgggccactggtgtgtccgtggatgccattttgataaggttgtcccattcctcagtccaattccgggtgtcatagcaaagccccgtttccacgaattcctgagatttaagggactccagctgccagcgaaatttgaagttgcgtgtgtccgtctccttgagggtgctgaagagcgccttcctcagcaccaagtctgtgtcctgaacaccccacatgtactgggaagcagcatgcatgaggcagttcccgtccccattcgttttcagtgccacaagcttcctcacttctcgacaccagttgagcttcttctggctttccagggaggcctggatgttcctgtcgatgagagctttgtggatgatctcccgaaattgcggacaaaactggcaggttctgaacatttccagagtgtatcggtgcatggatttaaaatggtgaatgattccattggtaggtttgaaaatatcttctggagttctctctcttatcttcacagccttccgcatgttgctcaaatacaaagccaggggaaggagttgctcagccatggtggcggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatggggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgttaagtgccgcggtcgtcggcgcctccgccctcccccttgggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagcccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggctgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcc

SEQ ID NO: 229 - DNA, 28554 bp, synthetic construct
  misc_feature 1..28554: note = 17P1
  source 1..28554: mol_type = other DNA
taagctccctttcctgctttccaggaaaggttttttcatcctcagagcccaaagattgaatatggaaaaattatgaagtgttttgagcatctggcctctgcctaataaagacatttattttcattgcactggtgtatttaaattatttcactgtctcttactcagatgggcacatgggagggcaaaacactgaagacataaagaaatgaagggctagtcgagaccttgagaaaatatatcagtatcttggaccccatgacagcagtggttgtaaatagctgatgttatggaaaacaggctttgctccttagccttactctcccttaaagaattcaagttgcagcttgatttgggagttagatattgctaaattttatttaaataaattatgttatttaccctttcttgtaaatgtcttctttctctttaattatccagaatatcacttagattcattaagttcttctgcctaattacaccactgttttaagattttctttttgcattttactgtccccatttctctttctcccctgttctctttttatcctagttttctctgccatcttaaaagaactacaagaaagacagaaccttctgtgctggattcggaaaatgacatatgaattatgagtaatccttgttccttcttgcatcctaattctgaatctcagttcagttcacttcagtctctcagttatgtacgattctttgcaatcccatggactgcagcataccaggctcccctgtccatcaccaactcctggagcttgcttaaattcatgtccatcgagttggtgatgccattcaaccatttcatcctctgtcgtccccttcctctgctttcaatctttcccagcatcagggtcttttccagtgagtccgttcttcacatcaagtggccaaagtgttgaagtttcagcttcagcatcggtccttccaataaatattcaggacttatttcctttaggtttgactggtttcatctccttgcaccccaaggtactctcgagagtcttctccaacatcgcaatccgatggcatcaattctttggcagtcagctttctttatgatccaactctcacatccatacatggctactggaaaaaccatagctttgactagatggaactttgtcggccaagcaatgtctctgctttttaataagctgtctagctttttatagacagcttattatagcttgttatagcttttcttccaaggagcaagcatcttttaatttcatgtctgcagtcaccatatgcagtgactttggaggccaggaaaataaagtctgtcactatttccactgcttccatctctttgcaatcaagtgatgggaccggatgccatggtcttcattttttgactgttgagttttaagacagctttttaattctcttctttcactttcatgaagaggctgtttagttcctctttggtgtctgccataagggtgggtgtcatctgtatatatgaagttattgatatttctcctggcaaccttgattccagcttgtgcttcatccagccctgcatttctcatgatgtactctgcatagaagttaaataatcgaggtgacaatacgcagctttgacctatttctttccctgttctgaatccagttggggagatgctgaaagtaacacatctaacaagtgactgtaaatgagtgtattcaaggtttttatgagatcagataatgaagcccttggtatgaaatgggtagtaaagataagtagtacagacaattgtccaaaagacaagaagacaaaagtcagaaaagcaaaggatagcataggccaaatcactgatgaataatgtgtttgtgtattctgagaatttcaggtaaacagaaaaacaaatgaagcaaaactgcctgggatagaatagaatagatactatattttggtgtacactgtggacacattcttaaagttaaaaattcaccaagaagattccatctagacattactcacaagatatttgcactggtaatcagccacagaatgaggtgtccataggcattaaggaaagtggtagaaaagaagcacccagcgtagctcgggttagtgaaccgaggcacttcatgctgcatatttgtattgcacgtttcagtgtacatcgtgtttcacttcctatatctcgttggacacttcagtttgccatatgatatgtccagggggttcaggcacggaggaagggcctcggaagacctcggggggagaggggcaggcactgctgtgtattgatggggggattgtttgcactggttgatgatctctgaacaaccaagaagtacacaaggatctacctaactggacgtgctaagtaatttcactttggggattattctccagggagacgatccattgatagagaagtgaaaagcatcgagatgtgtctagtagttgtaggaagtctggggtgctttcctgatggggtgccctcagctggaaatagcccctccttcctttgacctgtcctgtggctatttgcagacattttattcctcttaccagactgtaagctctttgaggctggatttctgccttttgtctattcattcattcactcattcttctattcatgcattcaccaattccacaagtagttgttgcctgtaacatgtgccagagattgtaccaggcagatgggcatatctagataagcaaaagacatgatcctttctcttctggagctaacaatctactgggggcagagataatagcaaacaagtaaatatataatggttaaatagaaatttcgaatttggaacattctcatgaggaaaacagctaagatatggagggagagaagaagccagaaggtgacgggacgaggcagctggcacagccctaggcccaggaattcaacaggcatctactgagtggacccaacgcatgagaggacagtgccaagcaagcaactcaaatgtcccaccggttgggcatggccaggtagcctatgctgtgtctggacgtcctcctgctggtatagttattttaaaatcagaaggacagggaagggagcagtggttcacgcctgtaatcccagcaatttgggaggccaaggtgggtagatcacctgagattaggagttggagaccagcctggccaatatggtgaaaccccgtctctaccaaaaaaacaaaaattagctgagcctggtcatgcatgcctggaatcccaacaactcgggaggctgaggcaggagaatcgcttgaacccaggaggcggagattgcagtgagccaagattgtgccactgcactccagcttggttcccaatagaccccgcaggccctacaggttgtcttcccaacttgccccttgctccataccacccccctccaccccataatattatagaaggacacctagtcagacaaaatgatgcaacttaattttattaggacaaggctggtgggcactggagtggcaacttccagggccaggagaggcactggggaggggtcacagggatgccacccgggcagtcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcatagggtcattaattgtaaaggaaaggtgccgacctccggtcacctattcaggcatagaagctttttaaaccgagcgcttttatagaagccccagtccccttctcagatcccgagtgtcgcgtgttacctcggggtacctgaagggcatccttagcctgtcaccagtgtgtgggtaccagtttcaatgtcactttaaagtgggtttcgcagtaaagtcgccgtgctggggttgcacacatgacgggcccgtgtgggcgtggcttttggccccgtgggtccttgttaccaaggaggagttcccacggccgtcatgctccgctacgaagcaacagtgctgttactaacactcgccagtggatcgagcgtggagccaaacacagtacaaagtgttacccctctagacctggaaagaccaggcggagtttcaagttgcacgttttgtgtcagttggggaaacctgcttattaaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggctgtctgttacaacacaaaaacaacaggaaaaaaaaaagcccaaagttcagcaagaaattcacaggccaatatatacccagtgctaaataattcattatcactttgtagtagccaaataactgacgtgcctaaaaacctcacaggcttgacaattaacctcaaatccaacgtctcaggcgtttaagaaagcaaaacatggaaacctgacccaggtaaattcgcggacctacttatcctccccctcaatggatgtctgtcctctgtcaacacggcagcgtttaccccaggcccaaaccctgtgtccccaaactactaaacatcttcctacacacatagcggcaggtggccccaccctaggctatgagcccacaaaaaggggtgaggcctcgtcacggtcgtggatcgcaagtcccctgccccagaagcgttcaggccaactcagcggcaccagcagttagtgtcccttcacagggacggaaaaccgaagttctcgccgcgcgccagccagccagtcgagccggaaagcaatgacctagcattcgatccccgaaacactgcacaaccccgttccacaaacggccgggccccgccatcaatggaagcctccgcgcctctcgtttccgtttcacccagtgctcctcgcccgcccccaatttctctctcccacctcagagcccgcttcagaggccggcttctcccacagagagattgggaacggccgccattttgctctaggtggccgttcgtcttaaggctattccgcacgagggccccgggtgactaagcagctcggctgcccttccgccgcggcgggcaagcagacctcccgcacccacccccgcagccgcaagacccccggacgtccgcctcaccaggtggcagtggcaacagcggtcacagaagaaacgcaggcaaactcccggcctccacgaaactgcctgcgccacacccggtgcttccttatatagccatcggtagcaccgccccagtagattcctccgcagaaacgccgagaagggactacttttcgcggcccttcctgccctctgaagagagaagcagtccccccagaatcttctaatttcactcctagaatgctttcctgtgaagactcgaacactggggctgattttgggggggggggacgaggccttagtcctgagcggccgagcggagggatcagcgtgttcgctgaacactgcgtccgcggacagggccggtactcggctggttggggggggtgtgggggaggtgccgcggaaggtgcgaaaacccgacacggagtcctctgagcgtccggagggggctgtccccgctgccggtccccggcgccccctcccctcaaccaggaaggctcgcctttcctgagacccgccctcggctaacaggggtcccgccgagcgcctcacgatgaatcggggtcccgctcccctggcccgagttccgccgtgcccctccccccaacccctcttccccgccagcgaaaccgtggggtctttattctgggtctcccataggtaacgatagtgtttctgtttccataaacttcccctcacccccagtgggtcgcgaggacttcccggggggtctagtcaccccaactgtggcggccgaacccatccccctgcgggcgggcaccgggacaagaggaatgactcgacaaatctcggggccgggcctcaagcccgcctcaggagggtcgtcaggacctgcaggaattttctcacaacgcaggagtgaaaaataagtgtccaaaggagaaatgcctgtgacaagttcacattgaattttgaaaagtaaaagcaaaaattccacacagctgtgaaacactccttgcgctggacctgaaagctgacagaactttgcggattgctcttcggccttcctgttttgttcccgattatgagcaagaaggcatcagaatttcacttctgctgccatttgaactcagaaatcagaaatcaaatctatttaaacccacgttttctttttttcttttttttaattttattttttaatgaagttttttattgtagttgatttataatgtcaatttctgctttacagcaaaatgatagtcatgcatatatatacatttcctttcttatcgctgagcctgagatttttaaaaggacactaattgtaagttctgtatagtcctggtggaaaaaagaccccaagtatgaaatttaaatctatagacaaattccatttggataaaagaaaaagatcaccagtcagatctttttcattttgatattttattttgtgatctctgtgtcatttctccagcatattttttccttttttcaaaaagcatacttaaatttttttccaaaggcatattttaaaaatgttttaaaatatatgaacgtgatgaaaacttaaaacaggttttctatagtttataatgaaaaacctccctcatgcactcaattccctagccactgttctttctagactcttctagaaatattctctatttctataaatgtggggagggtgtttttaatttttacccttgaagctttcaataaatatatagaaaaagagagaaccgactaaaaaataccctgctattaggaaaagactacattcctgttggaattataaacattatgttatttaaatactgtacttaaaatgagaataaaaacaaaactatgttttctttggcaacctgtgtctgtaggtatttatgggaaaggtctaagcagtattcaaaacagactttaactcctatcgttttaaacattttcaaagagaatgaattcattaccaagaaatgtaaatgaataataaaaataaaatgtcatttttcagtttagcaggagacctcagtgacttccagtagagatttctgtgagggatatttctaaatttctgaaaagagggtttaaaggaacagaacatcaaagctctgtataaggtttccttcttgaattccagaaagaagttttcagaggaacaaaaagctgaggttctttctcaggtgactaggcctggcttcaaaccacaccctgttttcttttggctgttctttcactgcaggtcttatgattcatgttgtttaaaggctgagtcacgagctttgtgacatagcttttttttcaagagtccaaaaactacagagaaaaacagacctgatttcagaggcaagggaaggtgaaaaggagaaagagggggagagggggaagaagaaaggctccaagggtgaggactgggtcccagggctatctccaaagagaaaacaatattcttaggcgctaacaacactgatgttgtctctagcaggaaaattctctactagagaattttggtctctaagtccaacagtgggttttgttgaagcaaatagaaataaacatttgtccaagggcactgaagtgaaagggaggagggggaagtaaactctcagggaggtagatgctgtttctctagagcagtggttctcaaccaggagcgacttggtcccttggtggacacttggcagtatctggagacatttttgcttgtcacagctgtggtgttggggttgaggtgtgccgctaaaatctagtggtagaggccagggatgttactaaacatcctgcagtggccagtcccccacaaaaacagaattacccagcccccaaagtcagcaatgcaatgggttgacaaattctgctctacggaggatttttgttgtttttgttagagctgcttttctgtttgctgagaagggctcccaaagtctaaatgtcccacttggattcggggatcgtgtaccaagtcacgttcctacaacctaaaatcccttgacctagaatgcaatgtgctagaatatgccagaagcaggatgagtcattggatccattttcagttccttccacccactgatccatcctttgcaggtgccccagaagggatggcttcagagctggcaccaatggaagagtgacagaggcccagcaacacggcaggattggcgggcaggcaagagcacgtgatgggctgagctcacaaagggcctgggtgttgggctgttggggattggactggagcctacctgtctgcctttcctcctttccccaaaggattcagctctcctgaaggtcaccaccttgtatgggacttaactcagcgtcatgagagtgtctacgtagtgaccagcaaacattttctttccaagagaaagggtgaaatctgagagctggacgggaaaggtttgacttgcgtcatcatcagttatataaccataaaagggaatctgcagcttaggagagaaaaaataaaaagaagccctagggactctactctgtccgttttcctgcttacatttatgtatttgcattctgtggcagaacacaaactgctccagcgagttcactcagactcacgtccatcgagtccgtgatgccatccagccatctcatcctctgtcgtccccttctcctcctgcccccaatccctcccagcatcagagtcttttccaatgagtcaactcttcgcatgaggtggccaaagtactggagtttcagctttagcatcattccttccaaagaaatcccagggctgatctccttcagaatagactggttggatctccttgcagttcaagggactctcaagagtcttctccatcaccacagttcaaaagcatcaattcttcggtgctcagccttcttcacagtccaactctcacatccatacatgaccacaggaaaaaccatagccttgactagatggacctttgttggcaaagtaatgtctctgcttttgaatatgctatctaggttggtcataactttccttccaaggagtgagcgtctttgaatttcatggctgcagtcaccatctgcagtgattttggagcccaaaaaaataaagtctgacactgtttccactgtttccccatctatttcccatgaagtgatggggccggatgccatgatcttcgttttctgaatgttgagctttaagccaactttttcactcttcactttcactttcatcaagaggcttttgagttcctcttcactttctgccgtaagggtggtgtcatctgcatatctgaggttattgatatttctcccggcaatcttgattccagcttgtgtttcttccagtccagcgtttctcatgatgtactctgcatagaagttaaataaacagggtgacaatatacagccttgatgtactccttttcctatttggaaccagtctgttgttccatgtcctgttctaactgttgcttcctgacctgcatacaaatttctcaagaggcagatcaggtggtctggtattcgcatctctttcagaattttccacagtttattgtgatccacacagtcaaaggctttggcatagtcaataaagcagaaatagatgtttttctggaactctcttgctttttccatgatccagcggatattggcaatttgatctctggttcttctgccttttctaaaaccagcttgaacatcaggaagttcatggttcacatattgctgaagcctggcttggataattttaagcattactttactagcatgtgagatgagtgcaatttcaagtaatagataatagtatttgtgctcaatacatcaacttctaaaagaccttgagatttacaaataattctaaagtcaaatggggacattacagggatattgatttcagctgaatgtaagcgatactttattgaaacttgaggggtttaatagaataaattgccttgtgaatagtgattcccttgacaccagtgctacacgagtgagtatgacctgtgagagatactatagcgtaagaatcctaaattagaagaaattaggatgaccttgaggaggccctgtgcatacatgctaagtcacttcagtcatgtccgacttccagacccagggatcaaatccatgtcttctgtggctcctgcattgcaggtggattctttaccactgagccacctgggaagcccctgtggggccctcctaaatccaaaattccatgatttttatttatttattttggctgcactgggtcttggttgtagcatgtgggatctttttagctgcagcatgtgggatctagttccctgaccagggatcaaacccaggccccctgcatttggagcttggggtcttagccactgcaccatgaaggaactcccccaaagtccatgattttaaagtcagacaattaaagattgacctgaagcagagggatggtttctgagctaagaaatggagctccagggttctgattattccaactttcaaccactccccaagtatatttacattaactactaaatgtaagatatcccaagtgaatacacatgtgtgccatttggaataacattcattacagcatctaagaacttcctaaaagcttttaaggaagatttgctgattattttcattgtaaaagaattattgattttgtaacatcatgttttacaaatatggatagaaataacaaaacataagagaaaaaaaacagagagataaattaatctgcaattttagtcggagattttaaaactcatttttcagtacttaagggtgtaaataggcttcctccccaaaaatcatctttgttgttaatttcttaattttcattagaggacatcctccatattaattcaatattgttaaatgctttgatacttgttttctgtttctgaaatacttggaaattaagcaacataattctaaattgccatagttaaagaagaaatcccaaagaaatttggaaaatatttgaactcgaggataatgaaatcacaaaatatcaaaatttgtagcatgtagctaaagcactgattaaaagaaaacttatacctttaaatcttatatttgaaaagaataaagctctaaagtagtaatctaaaaatccacttaaagaatataggcttttaaagacaaaaacttaaagtgagtagtaaagtagaaataataaagttatgagcaaaatttaacagacaatagagttactttgaacactaagcattgatttatagatcactagttacttagccaaggtgcttgggtgactaaaaacaactttaaaactgccctttgaagtgcatttagaaagaaaaagaaacgttcaagccgccattagggaagcagagtgtgatttaattcctttggaaaaacacagagcaccccacagttccatgcaaaaatagctgaagcttctcgcgtgctgtaatgtgtcaataactttagaaacctcatttcatttactcctcacccaagccttatgaggcaatattattatctctattttgtaggtgagcaaactgggtctcggggaggttaagtaatttcttcctgagcataagttcaagtccaggtccttctgattctttcccttattccaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagctttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactatcagttattcctaggaggttgtatagtcttctgattggaagccacaaatttcatataaactagtccaagtaattgtgctagagctaagatactcaaacctgaaatcagaagagggccatgcattggtatacacgccgcaatacagagactcagtccaaccacagcgaggatataggctatcacctgaataaccaatatggcaatgacgaaggaggttaatccaatcgctgtactaaacacatagtagtgaagtaatattaatatccctgtagaagtcacaattaaaccaaggccagtagcattctttaatgaatattcacctgggacgaaaagaatggctccaacaatgacaatgacagtgatcactagtccagcaacaagtaaagcaattgttttctcatccataccaccggatctatatttaagtgttttaataccaaactgtccccagaacaggagtatagcaaaaattgggaaaataacaataagaatattttcatttggagaaaaccatgaaacaacacgatattttagctcgatgatcgtttcaccttctctggttaattctgttacttcacaagtgtagtttcctgtgtgtgagacagcatcactcttatccatcttcaaagaggcatctccttttagtaattgtgagacttcaatttttgcactactaaagtcagtggggacagtggacttgtttagagctccatcaaaggtgtaaatatctcttcctttaaatttccactttacgtatacttcagtagtgttttgtgcctccatattagtaacaaagcatggaatgacgacagtgtcattacaaaacgtgaattctacagattttgttttattaaatagtagctgagctgatccgcagcacgccgagcccagcaacagcgccgctaccaggggccacataggtccagggttctcctccacgtctccagcctgcttcagcaggctgaagttagtagctccgcttcccaagctgtgagactcagacccctgggcactgtcgctccactcagccttagagtagctccctccttttccacctgagctcttcttcctccatatcacagcagcaaccacagctccagagaccacagatccaaggagaaccaggccagcaatgatgcccacgatggggatggtgggctgggaagccggcttccatctcagggtgacgggctcgggtagcccctcatgctgcacatggcacgtgtatctctgctcctctccagaaggcaccaccacagctgcccacttctggaaggttccatcccctgcaggcctggtctccacgagctccgtgtcctgggtatggccctccccatcctgctgccaggtcagtgtgatctccgcagggtagaagcccagggcccagcacctcagggtggcctcatggtcagagatggggtggtgagtcacgtgtgtctttgggggctccaggtgaagcagcgtctccttccccttctccaggtatttgtggagccactccacgcatgtgtcttccaggtaggctctctggtgctccgcctcagaggcatcatttgacttttgctcggagatctgagccgccgtgtccaccgcggtccaggagcgcaggtcctcattcagggtgagataatccttgccgtcgtaggcgaactgttcatacccgcggaggaagcgcccgtcgggccccagctcgcagccatgcatccactgcagggtgtgagacccggcctcgctctgattgtagcagccgcgcagcgtccgcagattcactcggaaaatctgtgcggtgtccctggcgctccgtgtctcccggtcccaatactctgacccctcctgctccatccacggcgcccgcggcaccatcctcggactcgcggcgtcgttgtcgaagcgcacgaactgggtgtcgtccacgtagcccacagagatgaagcggggctccccgcggccgggccgggacacggaagtgtggaaatacttcaaggagtgagatccggaaccgccaccaccgcttcctccgccgccactaccgccaccaccagaaccgccaccacccatgtcgcgatcccacttaactatcttgggctgtgacaaagtcacatggttcacacggcaggcatactcatctttttcagtgggggtgaattcagtgtagtacaagagatagaaagaccagtccttgctgaaagacaagtctgaatgctccactttttcaattctctctccattcttcagtaagtcaacttcaatgtcggatggatgaaacccagacacatagcaattcaggaaatttgactttccattctctgctggatgacgtgagtaaacctgaatctttggcgtacgctggatggagccgccaccaccagaaccgccaccaccggaaccgccgcaacccaggaagagggttcggggcgccatgacagcctcgaggccagaaagagagagtagcgcgagcacagctaaggccacggagcgagacatggtggcggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatggggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgttaagtgccgcggtcgtcggcgcctccgccctcccccttgggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagcccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggctgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcc

SEQ ID NO: 230 - DNA, 36738 bp, synthetic construct
  misc_feature 1..36738: note = 17S3
  source 1..36738: mol_type = other DNA
taagctccctttcctgctttccaggaaaggttttttcatcctcagagcccaaagattgaatatggaaaaattatgaagtgttttgagcatctggcctctgcctaataaagacatttattttcattgcactggtgtatttaaattatttcactgtctcttactcagatgggcacatgggagggcaaaacactgaagacataaagaaatgaagggctagtcgagaccttgagaaaatatatcagtatcttggaccccatgacagcagtggttgtaaatagctgatgttatggaaaacaggctttgctccttagccttactctcccttaaagaattcaagttgcagcttgatttgggagttagatattgctaaattttatttaaataaattatgttatttaccctttcttgtaaatgtcttctttctctttaattatccagaatatcacttagattcattaagttcttctgcctaattacaccactgttttaagattttctttttgcattttactgtccccatttctctttctcccctgttctctttttatcctagttttctctgccatcttaaaagaactacaagaaagacagaaccttctgtgctggattcggaaaatgacatatgaattatgagtaatccttgttccttcttgcatcctaattctgaatctcagttcagttcacttcagtctctcagttatgtacgattctttgcaatcccatggactgcagcataccaggctcccctgtccatcaccaactcctggagcttgcttaaattcatgtccatcgagttggtgatgccattcaaccatttcatcctctgtcgtccccttcctctgctttcaatctttcccagcatcagggtcttttccagtgagtccgttcttcacatcaagtggccaaagtgttgaagtttcagcttcagcatcggtccttccaataaatattcaggacttatttcctttaggtttgactggtttcatctccttgcaccccaaggtactctcgagagtcttctccaacatcgcaatccgatggcatcaattctttggcagtcagctttctttatgatccaactctcacatccatacatggctactggaaaaaccatagctttgactagatggaactttgtcggccaagcaatgtctctgctttttaataagctgtctagctttttatagacagcttattatagcttgttatagcttttcttccaaggagcaagcatcttttaatttcatgtctgcagtcaccatatgcagtgactttggaggccaggaaaataaagtctgtcactatttccactgcttccatctctttgcaatcaagtgatgggaccggatgccatggtcttcattttttgactgttgagttttaagacagctttttaattctcttctttcactttcatgaagaggctgtttagttcctctttggtgtctgccataagggtgggtgtcatctgtatatatgaagttattgatatttctcctggcaaccttgattccagcttgtgcttcatccagccctgcatttctcatgatgtactctgcatagaagttaaataatcgaggtgacaatacgcagctttgacctatttctttccctgttctgaatccagttggggagatgctgaaagtaacacatctaacaagtgactgtaaatgagtgtattcaaggtttttatgagatcagataatgaagcccttggtatgaaatgggtagtaaagataagtagtacagacaattgtccaaaagacaagaagacaaaagtcagaaaagcaaaggatagcataggccaaatcactgatgaataatgtgtttgtgtattctgagaatttcaggtaaacagaaaaacaaatgaagcaaaactgcctgggatagaatagaatagatactatattttggtgtacactgtggacacattcttaaagttaaaaattcaccaagaagattccatctagacattactcacaagatatttgcactggtaatcagccacagaatgaggtgtccataggcattaaggaaagtggtagaaaagaagcacccagcgtagctcgggttagtgaaccgaggcacttcatgctgcatatttgtattgcacgtttcagtgtacatcgtgtttcacttcctatatctcgttggacacttcagtttgccatatgatatgtccagggggttcaggcacggaggaagggcctcggaagacctcggggggagaggggcaggcactgctgtgtattgatggggggattgtttgcactggttgatgatctctgaacaaccaagaagtacacaaggatctacctaactggacgtgctaagtaatttcactttggggattattctccagggagacgatccattgatagagaagtgaaaagcatcgagatgtgtctagtagttgtaggaagtctggggtgctttcctgatggggtgccctcagctggaaatagcccctccttcctttgacctgtcctgtggctatttgcagacattttattcctcttaccagactgtaagctctttgaggctggatttctgccttttgtctattcattcattcactcattcttctattcatgcattcaccaattccacaagtagttgttgcctgtaacatgtgccagagattgtaccaggcagatgggcatatctagataagcaaaagacatgatcctttctcttctggagctaacaatctactgggggcagagataatagcaaacaagtaaatatataatggttaaatagaaatttcgaatttggaacattctcatgaggaaaacagctaagatatggagggagagaagaagccagaaggtgacgggacgaggcagctggcacagccctaggcccaggaattcaacaggcatctactgagtggacccaacgcatgagaggacagtgccaagcaagcaactcaaatgtcccaccggttgggcatggccaggtagcctatgctgtgtctggacgtcctcctgctggtatagttattttaaaatcagaaggacagggaagggagcagtggttcacgcctgtaatcccagcaatttgggaggccaaggtgggtagatcacctgagattaggagttggagaccagcctggccaatatggtgaaaccccgtctctaccaaaaaaacaaaaattagctgagcctggtcatgcatgcctggaatcccaacaactcgggaggctgaggcaggagaatcgcttgaacccaggaggcggagattgcagtgagccaagattgtgccactgcactccagcttggttcccaatagaccccgcaggccctacaggttgtcttcccaacttgccccttgctccataccacccccctccaccccataatattatagaaggacacctagtcagacaaaatgatgcaacttaattttattaggacaaggctggtgggcactggagtggcaacttccagggccaggagaggcactggggaggggtcacagggatgccacccgggcagtcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagttgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaatcccaggccggccagggccagcgcgccaaggaccaggaccccaagcatagggtcattaattgtaaaggaaaggtgccgacctccggtcacctattcaggcatagaagctttttaaaccgagcgcttttatagaagccccagtccccttctcagatcccgagtgtcgcgtgttacctcggggtacctgaagggcatccttagcctgtcaccagtgtgtgggtaccagtttcaatgtcactttaaagtgggtttcgcagtaaagtcgccgtgctggggttgcacacatgacgggcccgtgtgggcgtggcttttggccccgtgggtccttgttaccaaggaggagttcccacggccgtcatgctccgctacgaagcaacagtgctgttactaacactcgccagtggatcgagcgtggagccaaacacagtacaaagtgttacccctctagacctggaaagaccaggcggagtttcaagttgcacgttttgtgtcagttggggaaacctgcttattaaggactcgggtcaaatgcagcgtttgtaaaaactccatatgttcctaggtggctgtgaggattcaaggggcatttcccatcatctttttgtctgaaacgcttgatctgagacatccgctctgcttggcgccttcggtgccggcacctgacacagaagaagatgcctagcccaatgaaaagcaggaggccggcgacgccccccagcacaatcagggccattggctgcaccggggtggaccatgtgggcagaaccttgatgttggattccagcaggacctgtcccgagtcactcagcagacactgccacatccccgcctcagggttcagcacccacaccgccttctcccgcttcgagacctttgcctccttgttctccagtttcaaactcagcatcagcttaggggaggtgggtccccacacctcacaggtcaaatttttctggagctgagtggctctcatcaccaccaggttcacttcctgatgcaactttcctgttttcgcttcaagggccagggtgaggtttccagagccagcatactgaggcaaggcctggggcagggtgaggtggagcgggagcttcttgcccatctggagcttagggtcctgggtaacccgttttacagacacttccttgttcttcaggtcaaaggtgatccaagacttggaggaggaagccctctccgcctgccaccacagctcgccactgcccgtcagcttttcaactgtaaaggcgagtgggaaggagaactccacctgttccccctctttcttatagactatgctggaggccttctggaaagctagcaccacgatgtctattttgaactccaccttcttctggttctgcaagacagtgcatgtccaggtgccactatcctggagctccagctgagacacggagagggtcttcccagatccaccaccaccgcttccgcctccgccacttcctccgccgccagatcctccgcctcccatatttttaacaaaaatttcttcatatgctattttcactctctgcttctttctttttcttttggttttaattaggcctccttttgatattctttggatgaaaccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattcaaaaaggctgggaaccttggttgattgcggagtcagggagttattcacagcattgagctgggttccataattatccacctggaaaccattcggaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttcttgttgcaatgttgtctttataatcctgtttgcattatctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctgtgataattgtgtgttcttcatcttcctcagaatcagcattaagaggggcaggggcaagattaagcagcaggcatacagaagcccaaagtgcatgtactttcttcattgtgtaaatcatggtggctgtctgttacaacacaaaaacaacaggaaaaaaaaaagcccaaagttcagcaagaaattcacaggccaatatatacccagtgctaaataattcattatcactttgtagtagccaaataactgacgtgcctaaaaacctcacaggcttgacaattaacctcaaatccaacgtctcaggcgtttaagaaagcaaaacatggaaacctgacccaggtaaattcgcggacctacttatcctccccctcaatggatgtctgtcctctgtcaacacggcagcgtttaccccaggcccaaaccctgtgtccccaaactactaaacatcttcctacacacatagcggcaggtggccccaccctaggctatgagcccacaaaaaggggtgaggcctcgtcacggtcgtggatcgcaagtcccctgccccagaagcgttcaggccaactcagcggcaccagcagttagtgtcccttcacagggacggaaaaccgaagttctcgccgcgcgccagccagccagtcgagccggaaagcaatgacctagcattcgatccccgaaacactgcacaaccccgttccacaaacggccgggccccgccatcaatggaagcctccgcgcctctcgtttccgtttcacccagtgctcctcgcccgcccccaatttctctctcccacctcagagcccgcttcagaggccggcttctcccacagagagattgggaacggccgccattttgctctaggtggccgttcgtcttaaggctattccgcacgagggccccgggtgactaagcagctcggctgcccttccgccgcggcgggcaagcagacctcccgcacccacccccgcagccgcaagacccccggacgtccgcctcaccaggtggcagtggcaacagcggtcacagaagaaacgcaggcaaactcccggcctccacgaaactgcctgcgccacacccggtgcttccttatatagccatcggtagcaccgccccagtagattcctccgcagaaacgccgagaagggactacttttcgcggcccttcctgccctctgaagagagaagcagtccccccagaatcttctaatttcactcctagaatgctttcctgtgaagactcgaacactggggctgattttgggggggggggacgaggccttagtcctgagcggccgagcggagggatcagcgtgttcgctgaacactgcgtccgcggacagggccggtactcggctggttggggggggtgtgggggaggtgccgcggaaggtgcgaaaacccgacacggagtcctctgagcgtccggagggggctgtccccgctgccggtccccggcgccccctcccctcaaccaggaaggctcgcctttcctgagacccgccctcggctaacaggggtcccgccgagcgcctcacgatgaatcggggtcccgctcccctggcccgagttccgccgtgcccctccccccaacccctcttccccgccagcgaaaccgtggggtctttattctgggtctcccataggtaacgatagtgtttctgtttccataaacttcccctcacccccagtgggtcgcgaggacttcccggggggtctagtcaccccaactgtggcggccgaacccatccccctgcgggcgggcaccgggacaagaggaatgactcgacaaatctcggggccgggcctcaagcccgcctcaggagggtcgtcaggacctgcaggaattttctcacaacgcaggagtgaaaaataagtgtccaaaggagaaatgcctgtgacaagttcacattgaattttgaaaagtaaaagcaaaaattccacacagctgtgaaacactccttgcgctggacctgaaagctgacagaactttgcggattgctcttcggccttcctgttttgttcccgattatgagcaagaaggcatcagaatttcacttctgctgccatttgaactcagaaatcagaaatcaaatctatttaaacccacgttttctttttttcttttttttaattttattttttaatgaagttttttattgtagttgatttataatgtcaatttctgctttacagcaaaatgatagtcatgcatatatatacatttcctttcttatcgctgagcctgagatttttaaaaggacactaattgtaagttctgtatagtcctggtggaaaaaagaccccaagtatgaaatttaaatctatagacaaattccatttggataaaagaaaaagatcaccagtcagatctttttcattttgatattttattttgtgatctctgtgtcatttctccagcatattttttccttttttcaaaaagcatacttaaatttttttccaaaggcatattttaaaaatgttttaaaatatatgaacgtgatgaaaacttaaaacaggttttctatagtttataatgaaaaacctccctcatgcactcaattccctagccactgttctttctagactcttctagaaatattctctatttctataaatgtggggagggtgtttttaatttttacccttgaagctttcaataaatatatagaaaaagagagaaccgactaaaaaataccctgctattaggaaaagactacattcctgttggaattataaacattatgttatttaaatactgtacttaaaatgagaataaaaacaaaactatgttttctttggcaacctgtgtctgtaggtatttatgggaaaggtctaagcagtattcaaaacagactttaactcctatcgttttaaacattttcaaagagaatgaattcattaccaagaaatgtaaatgaataataaaaataaaatgtcatttttcagtttagcaggagacctcagtgacttccagtagagatttctgtgagggatatttctaaatttctgaaaagagggtttaaaggaacagaacatcaaagctctgtataaggtttccttcttgaattccagaaagaagttttcagaggaacaaaaagctgaggttctttctcaggtgactaggcctggcttcaaaccacaccctgttttcttttggctgttctttcactgcaggtcttatgattcatgttgtttaaaggctgagtcacgagctttgtgacatagcttttttttcaagagtccaaaaactacagagaaaaacagacctgatttcagaggcaagggaaggtgaaaaggagaaagagggggagagggggaagaagaaaggctccaagggtgaggactgggtcccagggctatctccaaagagaaaacaatattcttaggcgctaacaacactgatgttgtctctagcaggaaaattctctactagagaattttggtctctaagtccaacagtgggttttgttgaagcaaatagaaataaacatttgtccaagggcactgaagtgaaagggaggagggggaagtaaactctcagggaggtagatgctgtttctctagagcagtggttctcaaccaggagcgacttggtcccttggtggacacttggcagtatctggagacatttttgcttgtcacagctgtggtgttggggttgaggtgtgccgctaaaatctagtggtagaggccagggatgttactaaacatcctgcagtggccagtcccccacaaaaacagaattacccagcccccaaagtcagcaatgcaatgggttgacaaattctgctctacggaggatttttgttgtttttgttagagctgcttttctgtttgctgagaagggctcccaaagtctaaatgtcccacttggattcggggatcgtgtaccaagtcacgttcctacaacctaaaatcccttgacctagaatgcaatgtgctagaatatgccagaagcaggatgagtcattggatccattttcagttccttccacccactgatccatcctttgcaggtgccccagaagggatggcttcagagctggcaccaatggaagagtgacagaggcccagcaacacggcaggattggcgggcaggcaagagcacgtgatgggctgagctcacaaagggcctgggtgttgggctgttggggattggactggagcctacctgtctgcctttcctcctttccccaaaggattcagctctcctgaaggtcaccaccttgtatgggacttaactcagcgtcatgagagtgtctacgtagtgaccagcaaacattttctttccaagagaaagggtgaaatctgagagctggacgggaaaggtttgacttgcgtcatcatcagttatataaccataaaagggaatctgcagcttaggagagaaaaaataaaaagaagccctagggactctactctgtccgttttcctgcttacatttatgtatttgcattctgtggcagaacacaaactgctccagcgagttcactcagactcacgtccatcgagtccgtgatgccatccagccatctcatcctctgtcgtccccttctcctcctgcccccaatccctcccagcatcagagtcttttccaatgagtcaactcttcgcatgaggtggccaaagtactggagtttcagctttagcatcattccttccaaagaaatcccagggctgatctccttcagaatagactggttggatctccttgcagttcaagggactctcaagagtcttctccatcaccacagttcaaaagcatcaattcttcggtgctcagccttcttcacagtccaactctcacatccatacatgaccacaggaaaaaccatagccttgactagatggacctttgttggcaaagtaatgtctctgcttttgaatatgctatctaggttggtcataactttccttccaaggagtgagcgtctttgaatttcatggctgcagtcaccatctgcagtgattttggagcccaaaaaaataaagtctgacactgtttccactgtttccccatctatttcccatgaagtgatggggccggatgccatgatcttcgttttctgaatgttgagctttaagccaactttttcactcttcactttcactttcatcaagaggcttttgagttcctcttcactttctgccgtaagggtggtgtcatctgcatatctgaggttattgatatttctcccggcaatcttgattccagcttgtgtttcttccagtccagcgtttctcatgatgtactctgcatagaagttaaataaacagggtgacaatatacagccttgatgtactccttttcctatttggaaccagtctgttgttccatgtcctgttctaactgttgcttcctgacctgcatacaaatttctcaagaggcagatcaggtggtctggtattcgcatctctttcagaattttccacagtttattgtgatccacacagtcaaaggctttggcatagtcaataaagcagaaatagatgtttttctggaactctcttgctttttccatgatccagcggatattggcaatttgatctctggttcttctgccttttctaaaaccagcttgaacatcaggaagttcatggttcacatattgctgaagcctggcttggataattttaagcattactttactagcatgtgagatgagtgcaatttcaagtaatagataatagtatttgtgctcaatacatcaacttctaaaagaccttgagatttacaaataattctaaagtcaaatggggacattacagggatattgatttcagctgaatgtaagcgatactttattgaaacttgaggggtttaatagaataaattgccttgtgaatagtgattcccttgacaccagtgctacacgagtgagtatgacctgtgagagatactatagcgtaagaatcctaaattagaagaaattaggatgaccttgaggaggccctgtgcatacatgctaagtcacttcagtcatgtccgacttccagacccagggatcaaatccatgtcttctgtggctcctgcattgcaggtggattctttaccactgagccacctgggaagcccctgtggggccctcctaaatccaaaattccatgatttttatttatttattttggctgcactgggtcttggttgtagcatgtgggatctttttagctgcagcatgtgggatctagttccctgaccagggatcaaacccaggccccctgcatttggagcttggggtcttagccactgcaccatgaaggaactcccccaaagtccatgattttaaagtcagacaattaaagattgacctgaagcagagggatggtttctgagctaagaaatggagctccagggttctgattattccaactttcaaccactccccaagtatatttacattaactactaaatgtaagatatcccaagtgaatacacatgtgtgccatttggaataacattcattacagcatctaagaacttcctaaaagcttttaaggaagatttgctgattattttcattgtaaaagaattattgattttgtaacatcatgttttacaaatatggatagaaataacaaaacataagagaaaaaaaacagagagataaattaatctgcaattttagtcggagattttaaaactcatttttcagtacttaagggtgtaaataggcttcctccccaaaaatcatctttgttgttaatttcttaattttcattagaggacatcctccatattaattcaatattgttaaatgctttgatacttgttttctgtttctgaaatacttggaaattaagcaacataattctaaattgccatagttaaagaagaaatcccaaagaaatttggaaaatatttgaactcgaggataatgaaatcacaaaatatcaaaatttgtagcatgtagctaaagcactgattaaaagaaaacttatacctttaaatcttatatttgaaaagaataaagctctaaagtagtaatctaaaaatccacttaaagaatataggcttttaaagacaaaaacttaaagtgagtagtaaagtagaaataataaagttatgagcaaaatttaacagacaatagagttactttgaacactaagcattgatttatagatcactagttacttagccaaggtgcttgggtgactaaaaacaactttaaaactgccctttgaagtgcatttagaaagaaaaagaaacgttcaagccgccattagggaagcagagtgtgatttaattcctttggaaaaacacagagcaccccacagttccatgcaaaaatagctgaagcttctcgcgtgctgtaatgtgtcaataactttagaaacctcatttcatttactcctcacccaagccttatgaggcaatattattatctctattttgtaggtgagcaaactgggtctcggggaggttaagtaatttcttcctgagcataagttcaagtccaggtccttctgattctttcccttattccaagttatcccaatccattcctctaataacaaattgctcactgacagcttgaagagcaaatgtgtttgggttaaattttgcccttaaaatgttttcactatgaattagttgccaatgtgtaaacatttgattttacatgaaagtctagataccctgtctgtctcaaagaatcagaaggtctggcagccctgcatctgagctttttttttttttttttggctgagtcaggttgcagcacttgggatctttaatttcagcatgagggatctagttctccaaccaggggttgaacctgggccccctccattggaaacacagagccttacacgctgaaccaccagggaagtcccctgaggtcttttaaaatatatatatatttagttttggctgtgctgggtgttggttgctgcaagagggctttctccagttgcagcgagcaggggctactgtactttctagttgtggtgagcaggcttctccctgagtggcttctcctgttgcagagcacaggctctaggtgcgagggcttcggtagttgtgatgtacgggcgtagttgccctgaggcatgtggaatcttcccagatcagggattgaacccgtgtcccctgcattggcatgtggattctcaaccactggaccaccaggaaagtcctcctgcagtcctgaatgcaggatcaggcaatgtaacaaggctggctgggccacatccttagctggggcctgagacttcaggctgccctggttcccacccctctgtgctgtatccttcacaagcagcctaagggctggttgctatttctcccttcacatgcagcccttgccacttatacctggcacctgttggcactgaatttgcaacccctcgtttagaattgggtctcaggtggcactagtggtaaagaacctgcctgtcaacacaggagacataagagacactggtttgatccctgggtctggaagatcccctggaagaggaaatggaaactcactccagtattcttgactggagaatcccatggacagaggagcctggcaggctgtggtccatggggttgcaaatagtcggacatgactgaagcaacttagtatgtacacatgcatttagaatctctcttccacatttcttgcgccagttcagatcccaaatattctggtcttattggtcccaaagccgtttttgcatggttcccatttcccacagggcttccctgatggctcagagagtaaagaatctgcctgcaatgcaggaaactcgggtttgatccttgggttgggaaaatcccctggggaatggcaacccactccagtattcttgcctggagaatcccatggacagaggagcctggcaggctacagtccatggggtcacaaagagctggacacgattgagtgactaacacacacacatttcccaagggtagttgggctaagcgtgtagtcaccttaaaatttctgcacaaaacgaattctatgatttctctcattacttcctcacatgttggaggcattttctctccctctgcacttaatagcctatcttgctttaatttcttcccactcttggaggctaggtttggtttggtgggctgatgagggagggagagaccgctccaagtactttagcgggtgggattgaaggcggagccctcctgagctatgagtgtcctatgagtggggctggaactaagaaccaggggcgtggacagggtgtgtcacagagaaggggatgtgcctgcttctttctggcccaggaggaaccgggtcaattcttcagcacctgggtacccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactatcagttattcctaggaggttgtatagtcttctgattggaagccacaaatttcatataaactagtccaagtaattgtgctagagctaagatactcaaacctgaaatcagaagagggccatgcattggtatacacgccgcaatacagagactcagtccaaccacagcgaggatataggctatcacctgaataaccaatatggcaatgacgaaggaggttaatccaatcgctgtactaaacacatagtagtgaagtaatattaatatccctgtagaagtcacaattaaaccaaggccagtagcattctttaatgaatattcacctgggacgaaaagaatggctccaacaatgacaatgacagtgatcactagtccagcaacaagtaaagcaattgttttctcatccataccaccggatctatatttaagtgttttaataccaaactgtccccagaacaggagtatagcaaaaattgggaaaataacaataagaatattttcatttggagaaaaccatgaaacaacacgatattttagctcgatgatcgtttcaccttctctggttaattctgttacttcacaagtgtagtttcctgtgtgtgagacagcatcactcttatccatcttcaaagaggcatctccttttagtaattgtgagacttcaatttttgcactactaaagtcagtggggacagtggacttgtttagagctccatcaaaggtgtaaatatctcttcctttaaatttccactttacgtatacttcagtagtgttttgtgcctccatattagtaacaaagcatggaatgacgacagtgtcattacaaaacgtgaattctacagattttgttttattaaatagtagctgagctgatccgcagcacgccgagcccagcaacagcgccgctaccaggggccacataggtccagggttctcctccacgtctccagcctgcttcagcaggctgaagttagtagctccgcttcccaagctgtgagactcagacccctgggcactgtcgctccactcagccttagagtagctccctccttttccacctgagctcttcttcctccatatcacagcagcaaccacagctccagagaccacagatccaaggagaaccaggccagcaatgatgcccacgatggggatggtgggctgggaagccggcttccatctcagggtgacgggctcgggtagcccctcatgctgcacatggcacgtgtatctctgctcctctccagaaggcaccaccacagctgcccacttctggaaggttccatcccctgcaggcctggtctccacgagctccgtgtcctgggtatggccctccccatcctgctgccaggtcagtgtgatctccgcagggtagaagcccagggcccagcacctcagggtggcctcatggtcagagatggggtggtgagtcacgtgtgtctttgggggctccaggtgaagcagcgtctccttccccttctccaggtatttgtggagccactccacgcatgtgtcttccaggtaggctctctggtgctccgcctcagaggcatcatttgacttttgctcggagatctgagccgccgtgtccaccgcggtccaggagcgcaggtcctcattcagggtgagataatccttgccgtcgtaggcgaactgttcatacccgcggaggaagcgcccgtcgggccccagctcgcagccatgcatccactgcagggtgtgagacccggcctcgctctgattgtagcagccgcgcagcgtccgcagattcactcggaaaatctgtgcggtgtccctggcgctccgtgtctcccggtcccaatactctgacccctcctgctccatccacggcgcccgcggcaccatcctcggactcgcggcgtcgttgtcgaagcgcacgaactgggtgtcgtccacgtagcccacagagatgaagcggggctccccgcggccgggccgggacacggaagtgtggaaatacttcaaggagtgagatccggaaccgccaccaccgcttcctccgccgccactaccgccaccaccagaaccgccaccacccatgtcgcgatcccacttaactatcttgggctgtgacaaagtcacatggttcacacggcaggcatactcatctttttcagtgggggtgaattcagtgtagtacaagagatagaaagaccagtccttgctgaaagacaagtctgaatgctccactttttcaattctctctccattcttcagtaagtcaacttcaatgtcggatggatgaaacccagacacatagcaattcaggaaatttgactttccattctctgctggatgacgtgagtaaacctgaatctttggcgtacgctggatggagccgccaccaccagaaccgccaccaccggaaccgccgcaacccaggaagagggttcggggcgccatgacagcctcgaggccagaaagagagagtagcgcgagcacagctaaggccacggagcgagacatggtggcggttgctgtggagagaaaaagtccatgtcgttaaaaaccagattaagcgcccaagatcgtctatcttaaagaccactcgccatcagctctcaagaccactcttaaatacacatcgctcggaaactgccctggtcggaaataaccacgcgacagggtcagagccagcatggaatgctgcagttaaggctgccatgccaaccgcagagcccgccgcagactgaaaacagcacctgccaagagggtctgcgccatagccgaccacgtggtccggtgccctggactgaactttcgccctccccctttcgcaccctcttctccacccttgcaaaggatgagaatcctcctccaccgccttgggcgcgtgccaatcaggacttcctcttttaggagaaacccgtctacgccggaaacggggagcggccgggattaaggagcgagctccacgccccgcaaaggagtgcagccccttcccccctctctcctcgcgccgggtgcggccgcaatcgcggtcaccttcctggttaaagcggccctgcccaccgagccccgaccctctatcccgattgcatcactgcctgccaccaggaacaaagctccccagccgagcaaaataatagctgcccgcagcccgcctgagatagaaagctgcaggccgccacaaactcagggaagctggggcgggaagcacactgcggcggcacaatgcaggtttggaagatattcagaagccttacctgaaacgtaggcctggtttagctagagaaaaaaagccgcaacccgaagcgctcccgacggttcaatgagaccggtttccgcccgtcgccctatctcttatacccggcctcagaaccttccagaaggggcccgcccctgccggtgcccatcattgctgcctcagccaatgggcgggcggttacctccgcaagccccaatgacgaacccggcttgactcctcgcacctcccccttccttccgcaacacgccccgcctcggatgacgcactcaccgcagcgttctggaactttcattctcgcccccgctctctgaacggcccgggggaaagggagggtggggccgacggagcccgcgcgcgggagtcctcagtcaccccgtgggggggagcggggggcggggaagagcgcgtccgcctctgcgcatgcgcccccagaaagcgcgggcgggagggaacggaaggagggggaggaagaggggcgggccaacttggagtcaaccaatgacagcgatctggctcagtgcggaacccggggagggtaagcgctcggcctgcagggaggggtccgactccagccgccgggagagaagacggaagtggagcgaggacaaaatggccgcgaaggttgttgcgcccctcccccaccaggtcctcattctcttccccgacacccactccggatatatagactgtcccccaggctctcccggactccacatccgcacatttcgtgaccggcgtgacgctggtctagggatgaccgtgagcgacagggccgaaggttccgaccccggggcgctgccggggtaaattcggccgggacacccagatctggggaaggaaggagctgcccggctgccgccgccggtcccgcctctgcctagggtgcggcagggtagcgtggcaggcccccgcggccgtccgttctctgtggcagctggaggccgtctgaccccgacacaggttggagaggctcgatttcttagcccactagcctgtgtcgagaccctcagcaaagtaaatggccaagcacgcttctcgaaggcctcggttacctccggtatcccgcggagaatagattcggcttcttttctcagcccctcctccacccgaccgagccccgttcttctctgttacttgttttaaaggaagaaaaggtggcgagttttttctttgtaaatgaaccagacgttaggaactttggttccggtagctttgtgtccttgatttaggcttcctgagccttttattttcagtaacaggagggaatagctatctgctttgattttcgtcagaaactaaaagagaggccaggcagagatgccttgaaaacatcactgaaggagtctagtgtacaaagcagtggacctagaattttcaattctgtctggtggcaggtgtttggggccttgtcattctaaaggcttctgagagcctttcttagtaccatgaaggctttcctacgtgctctttcaggcaggcagggcaagtaataaacccatttagtatgtgtgtgggcacggataggagaaaaggtttttttaagactatctagaacttttatcggcatcactggaattagaaaggtctccagacttccagaaaggctgttagaaaagtgaggatgacttgtccttgtcaaagccagtagagcctggagttagactcaaatgtttgataaaaagggtatttgccttttgggagggaatgtgggcttgagtctgttgaggaacatacctaatgcctccccatctctcaagaagttcgttttacatggggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgttaagtgccgcggtcgtcggcgcctccgccctcccccttgggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggcctcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgagtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcgggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttggccaccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagcccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaagggaaagcagatggtggagctgaatatgccacttaccagactaaatcaaccactccagcagagcagagaggctgataataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcttattaaagcagctgggacagggacagaaaaagggctttgactgcctttctcttgagcccttttcctgatctccacaactcactgataccactggtctcattggaaggggtgggctgttaacagtgtgacaaatgtaggaataaactggatgcaaaagggggctttgtgcagctttatattcactgttgtcttaaaccctttttatggactcaaatcaaatgacagtccctcaggatgttagcttctgaattcagaaagtgattgcagagttgcccactcctttatcctgtgtctgatggttttgctgtctctgtagtgattagcttactgtcaccatttcctcattcaataggcactcaggtggatgaaaggttctggttcactccccaaatacctgcaacagtcaggagtgtgtcaggccaaaaccagaaaacaggaattgccatggggtctccatgatgggtggcagggactcaagtacatgagccatattcggctgcttccaggtacattagcagaaaactagatcagaagtggagctgtggggaccagaataaacactttgatatgggatgttggtgtctcaagtagcaacttaaccccctgctcactaaaacactctaatcctcattacctaggagcaactgagcctgagggctatctaatatagctggtgacacagagatcatataccctggctaaaagcatggctgaatccatgaaagaaaatatatgctcaaaataggaatagaatacacagatttatgcacagatgcttacaaattttagccaatcctgatgacatggttaacttggagatctagatcagttcttgccagcatgcccagagaatagtacatgggaaaatttatagagatgatgagttagagacaaagtgagtgataatgacattgcctgggattgctgctaggtacactgaaaaatcagggaggaagatccaataaatgacccattcaaaatctagaaaacctgtcaacaggaactttggaaacttatttctaatttatctgttcatcaaggcagcaataagtctttctgtaaaatcattaaatatgcccaaatgtcaagttctatgtgagtcatgaaggtaacttgataatgctctacacttcatattttgttcaattgtttaatacaaaaagcacttttattttatttatttaattttttaaacgtttatttaataaatataaatttccaaattacagcttatagattacaatggcttcaccctcataacttccctcccacctgcaaccctcccatctcctgctccctctcccattccattcacatcaagattcatttttaattatctttatatacagaagatcaatttagtatatattaagtaaagattttaacagtttgcacccacacagaacataaagtataaatactgtttgagtactagttatagcattaattcacattgaacaacacattaaggacagagatcctacatgaggagtaagtgcacagcgactcctgtcgttgacttaacaaattgacattcttgtttagggggtcagttatctccccaggctcctgtcatgagttaccaaggctatggaggccttttgagttcactgacttcgatcttatttagacaaggtcatagtgaaagtggaagtccactcctccctttagagaacggtacctccttcctcaatggcccattctttcaactgggatctcgctcacagagatctttcatttagctcatttaactcctttttttttttttttttctagagcatcttacctttccattgcctgaaatactttcatgggctcttcagccagatgtgaatgccttaagggctgattctgaggccagagtgctgtttaggacatgtgccattctatgagtctgatgtgtatcccatttcccatgttggaatgttctctccatttttaattctgtcagttagtattagcagacactagtcttgtttatgtgatccctctgactcttatgcctatcattacgatcaattgtgaacagaaattgatcactgggactagtgagatggcattggaacatgccacctcaatgggattgaattcgaatcccctggtctgtttctaactctaccatttgaggtaagtcagtttgagcatgtcccgaattgcacatctcttccctctcttattcccactcttatatttaacagggattacttttcagttaaatttaaacacctaagaataattgtgtgttaattacagagttcaaccaatagtattaagtagaacaaccaaaaaatactaaaagggataaagtattacattgtacatcaacagtcaggacaagggctgttcaagtcactgtttctcatagtgttcatttcactttgacaggtttccgggtttcttcccccaaaggaagtatttcttttgcatatgcttcggagccactcttagctctggccacatagtaggttctcaaatatttgttgatagattggctcaaaaagttgcagtagtgctctacacgtggaagagacgatctagtaattagctcatttaaaataaaggttcctctttcttcaggaatatttttgaatatctgcctgattgccaaccaaaaaggcctcatcttgtcttgccctggatttatgcctaaaatgcagtcacaatggataggacgacaaaagatgaagccgtttattcaaatgggataggccatttttgagaaacagtgatttcacagcaaacgttggagtagtaaattgggtggataagcttcctggcgctgtagatcttagtctctacttgagatcgtgtataagcactgaactcaaaaaattctttttaggtttttcatgcttgcaaccaagagtatacactggaaaaaaaatgttaataggagggtagacacacactcagggtcttaaacgtaataaaattaggattagaagtaaagaaaactgtagtacttaagtctattctaaactcaaaaactggacgtctggagtaccacgtggtgtgtagaacgaacttagataaaagaactgaatggaaaaagccaagaggtcagcgcaggagcctgttcgccaggctgttggtcagcaaactgagccactcgcggattctcggccctgaagaccgccccgaggcccctgccgccgcggttccccggccttttacgcctccctctccagccggaaggggcgcggacggcaagggcggtggagaagccccggcagaggaagcggctccaggggttagtccttaacctgcgagaccgcaagactgaggaccggtggggtactgccgggtaagggctcccatctcggtccaactttgcagttaagctacgaccggttcagggaagattctggacgcctccccgccgccccaccccccagctgtgcggagagtaattcatacaaaaggaggactctcctcagccagggaaatcccagggaccgtcgataaactcccactaaacctagaaccgagtgagcgctcgaccccgcctcccacccaccagcagtcgtcatcctcctggttgagaggagcatgcgccgggcgccgtgtgctcgtcagtgggctgaacgcacatcgcccacggtccccgaagatggggggaggggacggcggtggaaccggtgccgggtggaggtggcgcggggtaaactgggaaagtggtgtcgtgtgctggctccgcccttttccccgagggtgggggaggaccatatataagcgccgtggtccccgcgaacgttctttttcgcaacgggtttgccgccaggacacaggtgagtacgggtgtggcctccgtccgcatggcctccgccggtggccacggccttagcgtgcctcccggccccccgcgcgtagagggctctgcgccctggtcctgattccgagctgcgggcggggggaggtggagaactcgaggccctccgctctcgcggttccctaccgcgtgcccggtggcggcctgctggggcgccgtggccgccgcgtgcgatccgcgccttcgcgcccgccccgtctgtcttcgcgctcgagttcggccggcagccgcgtgttactgccagggcggcccagccgaggccgcccaaggtggcctccgtgcccggcggtcccggggcagacggccgcggcggggcggggcgggcggtcggagacccagcgccccgcccgggcgggctgcgagcgcggaaagatggccgctcccggtctcaagatggaggacgcggacggcgggcggcgcacaaagggccgggcggtgctgcccgcgccgcttcccgggactcgcggcccgggtgggggaggggctgggcgccggggcggccccgttcgctgggtgtaggccgggcagggcccgcagggcgccggtgctaatgctccctggagtttgcccttggctgttggggttgtgcctgagtctccggtcgtcgggacagtagtttaaagaaggtttttgtcgtcttaggtgtcgtgaaagccatcgctaaaagctaagcaaaagccaccatggctgagcaactccttcccctggctttgtatttgagcaacatgcggaaggctgtgaagataagagagagaactccagaagatattttcaaacctaccaatggaatcattcaccattttaaatccatgcaccgatacactctggaaatgttcagaacctgccagttttgtccgcaatttcgggagatcatccacaaagctctcatcgacaggaacatccaggcctccctggaaagccagaagaagctcaactggtgtcgagaagtgaggaagcttgtggcactgaaaacgaatggggacgggaactgcctcatgcatgctgcttcccagtacatgtggggtgttcaggacacagacttggtgctgaggaaggcgctcttcagcaccctcaaggagacggacacacgcaacttcaaatttcgctggcagctggagtcccttaaatctcaggaattcgtggaaacggggctttgctatgacacccggaattggactgaggaatgggacaaccttatcaaaatggcatccacggacacaccagtggcccgaagtggacttcagtataattcactggaagaaatacacatattcgtcctttgcaacatcctcaggaggccaatcatcgtcatttcagacaagatgctgagaagtttggaatcgggttctaatttcgctcctctgaaggtgggcggaatttacttgcctctgcattggcccgcccaggaatgctacagataccctatcgttctcggctacgacagccaacactttgtccccctggtgaccctgaaggacagtgggccagaaatccgagctattccacttgttaacagagagcgaggaagattcgaagacttaaaagttcacttcttgacagatcccgaaaatgagatgaaggaaaagctcctgaaagagtacttgacggtgatagaaatccccgttcaaggctgggaccatggcaccacccatctaattaatgctgcaaagttggatgaagctaacttacccaaagaaataaacctggtagacgattacttcgaacttgtccagcatgagtacaagaagtggcaggaaaacaatgagcaggggcggagagccacgcaccctcagaaccctctggagccttccgtgccccagctttctctcatggacatcaagtgcgagacgcccaactgccctttcttcatgtcggtgaacacccagcccttgtgccacgagtgctcagagagacggcagaagaaccaaagcaaacccccaaagcccacctccaagccggaccccgaggcgctgcccggcctggcgcttggagcctcccgcggggaggcctggaaccccgaggagccctctgggggcccccgctcagcccctccgacggctcccagcctcttcctgttcagcgagactacggccatgaagtgcaggagccccggctgccccttcacgctcaacgtgcagcacaacggcttctgcgagcgatgccacaacgcccggcagctcaaccccggccaccccccggaccccacgcgccatctcgaccccagcaagtgccaagcctgcctccagaacgtcaccaggacgtttaacgggatctgcagcacttgctttaaaaggactacggctgagcccgcctccagcctcggctccagcatccccctatcctgccaccagcgctccaagtccgacccctcgcaactggcccagagcgtctccccacacccctgccgcagagccgggcctgaggctccctctggctgctccgcctcggccgcacggactccgggggacaggacggggacgagcaagtgcagaaaagccggctgcatgtactttgggactccggaaaacaaaggcttttgcacgctgtgtttcattgagtacagagaaaataaacatttcgtcactgcctcggggaaagccagtcccacggcctccaggttccagaatgccgtcccctgcctgggcagggaatgtggcgccctcggaagcacggtgtttgaaggatactgtcagaagtgtttcattgaggctcagaatcagagatttcatgaagcaaaaaggactgaagagcagctgaggctgagccagcgcagagacttgtcgcgagccacccagagcgcttccaggtccaagtgcgcccgggccacctgcaggaacgtgctggcctgctgcagccaggagctgtgcatagagtgccagccccttggccaacgagtgagccctggcgcccggcggccagagcccgtcccagaggatcccccgacgcagcgctgccgggcccccgcctgcgaccatttcggcaatgccaagtgtaacggctactgcaatgagtgctttcaattcaagcagatgtatggcggcagcggcgccaccaatttctcactactgaaacaggccggtgacgtcgaggagaaccccgggcctatggagcactcacagcccaacagcatgccccaggatttgtcagaggccctgaaggaggccaccaaggaggtgcacgtccaggctgagaatgccgagttcatgaagaactttcagaagggcgaggtcacccgagaaggctttaagctggtgatggcgtccttgtaccacatctacgatgccctggaggaggagattgagcacaacaaggagaacccggtctacacgcccctctacttcccggaagagctgcaccgccgggccgccctggagcaggacatggccttctggtatgggccccgctggcaggaggccatcccctacacgcaggccaccaagcgctacgtgcggcgactgcagcaggtggggcgcttcgagcccgagctgctggtggcccacgcctacacccgctacatgggtgacctgtctgggggccaggtcctcaagaagattgctcagaaggccctggacctgcccagctccggggagggcctggccttcttcactttccccaatgtcgccaacgccaccaagttcaagcagctgtaccgctcccgaatgaacactctggagatgacccccgaggtcaagcagagggtcctcgaagaagccaagaccgccttcctgctcaacattcagctgtttgaggaggtgcaggagctgctgacccaggacactaaggaccagagaccctcgcaggcatccgacatccgcaagagggccggcagccgggtgcaagactccactcccgtgacaacccccagggggaagccgcagctcagcgtcctctcccaggtgccgctcatccgatgggtcctgacactcagctttctggtggcaacggtcgccatggggctttatgccatgtgataagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcc

SEQ ID NO: 231 - DNA, 1692 bp, Homo sapiens
  source 1..1692: mol_type = genomic DNA
taaggaggcccccagtcccgacccttcgccccaagcccctcggggtccccgggcctggtactccttgccacacgggaggggcgcggaagccggggcggaggaggagccaaccccgggctgggctgggacccgcagaggaagacgctctagggatttgtcccggactagcgagatggcaaggctgaggacgggaggctgattgagaggcgaaggtacaccctaatctcaatacaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaaaactacccctaaaagccaaa

SEQ ID NO: 232 - DNA, 1182 bp, Homo sapiens
  source 1..1182: mol_type = genomic DNA
tgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 233 - DNA, 1978 bp, Sus scrofa
  source 1..1978: mol_type = genomic DNA
gacgatctagtaattagctcatttaaaataaaggttcctctttcttcaggaatatttttgaatatctgcctgattgccaaccaaaaaggcctcatcttgtcttgccctggatttatgcctaaaatgcagtcacaatggataggacgacaaaagatgaagccgtttattcaaatgggataggccatttttgagaaacagtgatttcacagcaaacgttggagtagtaaattgggtggataagcttcctggcgctgtagatcttagtctctacttgagatcgtgtataagcactgaactcaaaaaattctttttaggtttttcatgcttgcaaccaagagtatacactggaaaaaaaatgttaataggagggtagacacacactcagggtcttaaacgtaataaaattaggattagaagtaaagaaaactgtagtacttaagtctattctaaactcaaaaactggacgtctggagtaccacgtggtgtgtagaacgaacttagataaaagaactgaatggaaaaagccaagaggtcagcgcaggagcctgttcgccaggctgttggtcagcaaactgagccactcgcggattctcggccctgaagaccgccccgaggcccctgccgccgcggttccccggccttttacgcctccctctccagccggaaggggcgcggacggcaagggcggtggagaagccccggcagaggaagcggctccaggggttagtccttaacctgcgagaccgcaagactgaggaccggtggggtactgccgggtaagggctcccatctcggtccaactttgcagttaagctacgaccggttcagggaagattctggacgcctccccgccgccccaccccccagctgtgcggagagtaattcatacaaaaggaggactctcctcagccagggaaatcccagggaccgtcgataaactcccactaaacctagaaccgagtgagcgctcgaccccgcctcccacccaccagcagtcgtcatcctcctggttgagaggagcatgcgccgggcgccgtgtgctcgtcagtgggctgaacgcacatcgcccacggtccccgaagatggggggaggggacggcggtggaaccggtgccgggtggaggtggcgcggggtaaactgggaaagtggtgtcgtgtgctggctccgcccttttccccgagggtgggggaggaccatatataagcgccgtggtccccgcgaacgttctttttcgcaacgggtttgccgccaggacacaggtgagtacgggtgtggcctccgtccgcatggcctccgccggtggccacggccttagcgtgcctcccggccccccgcgcgtagagggctctgcgccctggtcctgattccgagctgcgggcggggggaggtggagaactcgaggccctccgctctcgcggttccctaccgcgtgcccggtggcggcctgctggggcgccgtggccgccgcgtgcgatccgcgccttcgcgcccgccccgtctgtcttcgcgctcgagttcggccggcagccgcgtgttactgccagggcggcccagccgaggccgcccaaggtggcctccgtgcccggcggtcccggggcagacggccgcggcggggcggggcgggcggtcggagacccagcgccccgcccgggcgggctgcgagcgcggaaagatggccgctcccggtctcaagatggaggacgcggacggcgggcggcgcacaaagggccgggcggtgctgcccgcgccgcttcccgggactcgcggcccgggtgggggaggggctgggcgccggggcggccccgttcgctgggtgtaggccgggcagggcccgcagggcgccggtgctaatgctccctggagtttgcccttggctgttggggttgtgcctgagtctccggtcgtcgggacagtagtttaaagaaggtttttgtcgtcttaggtgtcgtgaaagccatcgctaaaagctaagcaaaa

SEQ ID NO: 234 - DNA, 1467 bp, Sus scrofa
  source 1..1467: mol_type = genomic DNA
tgaatggaaaaagccaagaggtcagcgcaggagcctgttcgccaggctgttggtcagcaaactgagccactcgcggattctcggccctgaagaccgccccgaggcccctgccgccgcggttccccggccttttacgcctccctctccagccggaaggggcgcggacggcaagggcggtggagaagccccggcagaggaagcggctccaggggttagtccttaacctgcgagaccgcaagactgaggaccggtggggtactgccgggtaagggctcccatctcggtccaactttgcagttaagctacgaccggttcagggaagattctggacgcctccccgccgccccaccccccagctgtgcggagagtaattcatacaaaaggaggactctcctcagccagggaaatcccagggaccgtcgataaactcccactaaacctagaaccgagtgagcgctcgaccccgcctcccacccaccagcagtcgtcatcctcctggttgagaggagcatgcgccgggcgccgtgtgctcgtcagtgggctgaacgcacatcgcccacggtccccgaagatggggggaggggacggcggtggaaccggtgccgggtggaggtggcgcggggtaaactgggaaagtggtgtcgtgtgctggctccgcccttttccccgagggtgggggaggaccatatataagcgccgtggtccccgcgaacgttctttttcgcaacgggtttgccgccaggacacaggtgagtacgggtgtggcctccgtccgcatggcctccgccggtggccacggccttagcgtgcctcccggccccccgcgcgtagagggctctgcgccctggtcctgattccgagctgcgggcggggggaggtggagaactcgaggccctccgctctcgcggttccctaccgcgtgcccggtggcggcctgctggggcgccgtggccgccgcgtgcgatccgcgccttcgcgcccgccccgtctgtcttcgcgctcgagttcggccggcagccgcgtgttactgccagggcggcccagccgaggccgcccaaggtggcctccgtgcccggcggtcccggggcagacggccgcggcggggcggggcgggcggtcggagacccagcgccccgcccgggcgggctgcgagcgcggaaagatggccgctcccggtctcaagatggaggacgcggacggcgggcggcgcacaaagggccgggcggtgctgcccgcgccgcttcccgggactcgcggcccgggtgggggaggggctgggcgccggggcggccccgttcgctgggtgtaggccgggcagggcccgcagggcgccggtgctaatgctccctggagtttgcccttggctgttggggttgtgcctgagtctccggtcgtcgggacagtagtttaaagaaggtttttgtcgtcttaggtgtcgtgaaagccatcgctaaaagctaagcaaaa

SEQ ID NO: 235 - DNA, 952 bp, Sus scrofa
  source 1..952: mol_type = genomic DNA
ccgggcgccgtgtgctcgtcagtgggctgaacgcacatcgcccacggtccccgaagatggggggaggggacggcggtggaaccggtgccgggtggaggtggcgcggggtaaactgggaaagtggtgtcgtgtgctggctccgcccttttccccgagggtgggggaggaccatatataagcgccgtggtccccgcgaacgttctttttcgcaacgggtttgccgccaggacacaggtgagtacgggtgtggcctccgtccgcatggcctccgccggtggccacggccttagcgtgcctcccggccccccgcgcgtagagggctctgcgccctggtcctgattccgagctgcgggcggggggaggtggagaactcgaggccctccgctctcgcggttccctaccgcgtgcccggtggcggcctgctggggcgccgtggccgccgcgtgcgatccgcgccttcgcgcccgccccgtctgtcttcgcgctcgagttcggccggcagccgcgtgttactgccagggcggcccagccgaggccgcccaaggtggcctccgtgcccggcggtcccggggcagacggccgcggcggggcggggcgggcggtcggagacccagcgccccgcccgggcgggctgcgagcgcggaaagatggccgctcccggtctcaagatggaggacgcggacggcgggcggcgcacaaagggccgggcggtgctgcccgcgccgcttcccgggactcgcggcccgggtgggggaggggctgggcgccggggcggccccgttcgctgggtgtaggccgggcagggcccgcagggcgccggtgctaatgctccctggagtttgcccttggctgttggggttgtgcctgagtctccggtcgtcgggacagtagtttaaagaaggtttttgtcgtcttaggtgtcgtgaaagccatcgctaaaagctaagcaaaa

SEQ ID NO: 236 - DNA, 2509 bp, Sus scrofa
  source 1..2509: mol_type = genomic DNA
catgtaaaacgaacttcttgagagatggggaggcattaggtatgttcctcaacagactcaagcccacattccctcccaaaaggcaaataccctttttatcaaacatttgagtctaactccaggctctactggctttgacaaggacaagtcatcctcacttttctaacagcctttctggaagtctggagacctttctaattccagtgatgccgataaaagttctagatagtcttaaaaaaaccttttctcctatccgtgcccacacacatactaaatgggtttattacttgccctgcctgcctgaaagagcacgtaggaaagccttcatggtactaagaaaggctctcagaagcctttagaatgacaaggccccaaacacctgccaccagacagaattgaaaattctaggtccactgctttgtacactagactccttcagtgatgttttcaaggcatctctgcctggcctctcttttagtttctgacgaaaatcaaagcagatagctattccctcctgttactgaaaataaaaggctcaggaagcctaaatcaaggacacaaagctaccggaaccaaagttcctaacgtctggttcatttacaaagaaaaaactcgccaccttttcttcctttaaaacaagtaacagagaagaacggggctcggtcgggtggaggaggggctgagaaaagaagccgaatctattctccgcgggataccggaggtaaccgaggccttcgagaagcgtgcttggccatttactttgctgagggtctcgacacaggctagtgggctaagaaatcgagcctctccaacctgtgtcggggtcagacggcctccagctgccacagagaacggacggccgcgggggcctgccacgctaccctgccgcaccctaggcagaggcgggaccggcggcggcagccgggcagctccttccttccccagatctgggtgtcccggccgaatttaccccggcagcgccccggggtcggaaccttcggccctgtcgctcacggtcatccctagaccagcgtcacgccggtcacgaaatgtgcggatgtggagtccgggagagcctgggggacagtctatatatccggagtgggtgtcggggaagagaatgaggacctggtgggggaggggcgcaacaaccttcgcggccattttgtcctcgctccacttccgtcttctctcccggcggctggagtcggacccctccctgcaggccgagcgcttaccctccccgggttccgcactgagccagatcgctgtcattggttgactccaagttggcccgcccctcttcctccccctccttccgttccctcccgcccgcgctttctgggggcgcatgcgcagaggcggacgcgctcttccccgccccccgctcccccccacggggtgactgaggactcccgcgcgcgggctccgtcggccccaccctccctttcccccgggccgttcagagagcgggggcgagaatgaaagttccagaacgctgcggtgagtgcgtcatccgaggcggggcgtgttgcggaaggaagggggaggtgcgaggagtcaagccgggttcgtcattggggcttgcggaggtaaccgcccgcccattggctgaggcagcaatgatgggcaccggcaggggcgggccccttctggaaggttctgaggccgggtataagagatagggcgacgggcggaaaccggtctcattgaaccgtcgggagcgcttcgggttgcggctttttttctctagctaaaccaggcctacgtttcaggtaaggcttctgaatatcttccaaacctgcattgtgccgccgcagtgtgcttcccgccccagcttccctgagtttgtggcggcctgcagctttctatctcaggcgggctgcgggcagctattattttgctcggctggggagctttgttcctggtggcaggcagtgatgcaatcgggatagagggtcggggctcggtgggcagggccgctttaaccaggaaggtgaccgcgattgcggccgcacccggcgcgaggagagaggggggaaggggctgcactcctttgcggggcgtggagctcgctccttaatcccggccgctccccgtttccggcgtagacgggtttctcctaaaagaggaagtcctgattggcacgcgcccaaggcggtggaggaggattctcatcctttgcaagggtggagaagagggtgcgaaagggggagggcgaaagttcagtccagggcaccggaccacgtggtcggctatggcgcagaccctcttggcaggtgctgttttcagtctgcggcgggctctgcggttggcatggcagccttaactgcagcattccatgctggctctgaccctgtcgcgtggttatttccgaccagggcagtttccgagcgatgtgtatttaagagtggtcttgagagctgatggcgagtggtctttaagatagacgatcttgggcgcttaatctggtttttaacgacatggactttttctctccacagcaacc

SEQ ID NO: 237 - DNA, 1861 bp, Sus scrofa
  source 1..1861: mol_type = genomic DNA
aagaacggggctcggtcgggtggaggaggggctgagaaaagaagccgaatctattctccgcgggataccggaggtaaccgaggccttcgagaagcgtgcttggccatttactttgctgagggtctcgacacaggctagtgggctaagaaatcgagcctctccaacctgtgtcggggtcagacggcctccagctgccacagagaacggacggccgcgggggcctgccacgctaccctgccgcaccctaggcagaggcgggaccggcggcggcagccgggcagctccttccttccccagatctgggtgtcccggccgaatttaccccggcagcgccccggggtcggaaccttcggccctgtcgctcacggtcatccctagaccagcgtcacgccggtcacgaaatgtgcggatgtggagtccgggagagcctgggggacagtctatatatccggagtgggtgtcggggaagagaatgaggacctggtgggggaggggcgcaacaaccttcgcggccattttgtcctcgctccacttccgtcttctctcccggcggctggagtcggacccctccctgcaggccgagcgcttaccctccccgggttccgcactgagccagatcgctgtcattggttgactccaagttggcccgcccctcttcctccccctccttccgttccctcccgcccgcgctttctgggggcgcatgcgcagaggcggacgcgctcttccccgccccccgctcccccccacggggtgactgaggactcccgcgcgcgggctccgtcggccccaccctccctttcccccgggccgttcagagagcgggggcgagaatgaaagttccagaacgctgcggtgagtgcgtcatccgaggcggggcgtgttgcggaaggaagggggaggtgcgaggagtcaagccgggttcgtcattggggcttgcggaggtaaccgcccgcccattggctgaggcagcaatgatgggcaccggcaggggcgggccccttctggaaggttctgaggccgggtataagagatagggcgacgggcggaaaccggtctcattgaaccgtcgggagcgcttcgggttgcggctttttttctctagctaaaccaggcctacgtttcaggtaaggcttctgaatatcttccaaacctgcattgtgccgccgcagtgtgcttcccgccccagcttccctgagtttgtggcggcctgcagctttctatctcaggcgggctgcgggcagctattattttgctcggctggggagctttgttcctggtggcaggcagtgatgcaatcgggatagagggtcggggctcggtgggcagggccgctttaaccaggaaggtgaccgcgattgcggccgcacccggcgcgaggagagaggggggaaggggctgcactcctttgcggggcgtggagctcgctccttaatcccggccgctccccgtttccggcgtagacgggtttctcctaaaagaggaagtcctgattggcacgcgcccaaggcggtggaggaggattctcatcctttgcaagggtggagaagagggtgcgaaagggggagggcgaaagttcagtccagggcaccggaccacgtggtcggctatggcgcagaccctcttggcaggtgctgttttcagtctgcggcgggctctgcggttggcatggcagccttaactgcagcattccatgctggctctgaccctgtcgcgtggttatttccgaccagggcagtttccgagcgatgtgtatttaagagtggtcttgagagctgatggcgagtggtctttaagatagacgatcttgggcgcttaatctggtttttaacgacatggactttttctctccacagcaacc

SEQ ID NO: 238 - DNA, 1297 bp, Sus scrofa
  source 1..1297: mol_type = genomic DNA
acccctccctgcaggccgagcgcttaccctccccgggttccgcactgagccagatcgctgtcattggttgactccaagttggcccgcccctcttcctccccctccttccgttccctcccgcccgcgctttctgggggcgcatgcgcagaggcggacgcgctcttccccgccccccgctcccccccacggggtgactgaggactcccgcgcgcgggctccgtcggccccaccctccctttcccccgggccgttcagagagcgggggcgagaatgaaagttccagaacgctgcggtgagtgcgtcatccgaggcggggcgtgttgcggaaggaagggggaggtgcgaggagtcaagccgggttcgtcattggggcttgcggaggtaaccgcccgcccattggctgaggcagcaatgatgggcaccggcaggggcgggccccttctggaaggttctgaggccgggtataagagatagggcgacgggcggaaaccggtctcattgaaccgtcgggagcgcttcgggttgcggctttttttctctagctaaaccaggcctacgtttcaggtaaggcttctgaatatcttccaaacctgcattgtgccgccgcagtgtgcttcccgccccagcttccctgagtttgtggcggcctgcagctttctatctcaggcgggctgcgggcagctattattttgctcggctggggagctttgttcctggtggcaggcagtgatgcaatcgggatagagggtcggggctcggtgggcagggccgctttaaccaggaaggtgaccgcgattgcggccgcacccggcgcgaggagagaggggggaaggggctgcactcctttgcggggcgtggagctcgctccttaatcccggccgctccccgtttccggcgtagacgggtttctcctaaaagaggaagtcctgattggcacgcgcccaaggcggtggaggaggattctcatcctttgcaagggtggagaagagggtgcgaaagggggagggcgaaagttcagtccagggcaccggaccacgtggtcggctatggcgcagaccctcttggcaggtgctgttttcagtctgcggcgggctctgcggttggcatggcagccttaactgcagcattccatgctggctctgaccctgtcgcgtggttatttccgaccagggcagtttccgagcgatgtgtatttaagagtggtcttgagagctgatggcgagtggtctttaagatagacgatcttgggcgcttaatctggtttttaacgacatggactttttctctccacagcaac

SEQ ID NO: 239 - DNA, 1636 bp, synthetic construct
  misc_feature 1..1636: note = Synthetic construct
  source 1..1636: mol_type = other DNA
aataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgagtcccataagattatgatgccatatttttactgtacctcttcttgtgcctagatacacaaatactgacttgtgttataattgcctgcagtattcaataatatggtgtatagatttgtagcctaggagctataacctatactatatagcctaggagtgcaggagggtatgccatctagatttgtgtgagtacactgatgtttgaacaataaaatcacctaatgataggtttctcaaaccatatcccagtccttaagcaacacatgactaatggattcaaccatttcccctgttcgttcagattgctttttctttttgcccctacaattttgttgataatactgttttttggggcttttgtttttgtttttttttttttttttgagacaagagtctcactctgtcgtcaggctggagtgcaatggcgctatctcagctcactgcaacctctgcctcccaggttcaagcgattctcctgcctcagcctcctgagtagctgagattacaggcatgcgccaccgcgcccggctaattttgtatttttagtagagacacagtttcaccatgttggtcaggctggtcttgaacacccgacctcaggtgatccacccgcctcagcttcccaaagtgctgggattaaaggcgtgagccaccacacctggccaatttactgttttataccatgcttttttgtgtgtattctaggttccctaaagcaaacatgcattttaaattttgatagaaccagatgacatacaaaagtgcctgttttctctgcattattaaaactgaaggtaatcagtcttttatttctatgactccaactggcaaaaaatatttgccattttaactttttttttttgagacagagtcaaaaggtgccagttttctctgcattattaaaacggaaggtaatcagtcttttatttctatcactccaactggcaaaagatatttgccacgttaacttttttttttttttttttgagacagaggctcacactgtcacccaggctgaagtgcagtggcatgatctcagctcacttgcaacctccgcctcccaggttcaagtgattctcctgcctcagcctcccaaggagttgggattacaggcgcatacccggcttattttttgtatttttagtagaaacgggatttcaccgtgttagccaggatggtatcaatctccagacttcgtgatcgcccacctcggcctcccaaagtgctgggattacaggcgtgagccaccgcgcccggccctcagtaggcgatttttatatgtggtataaagtagaattcttacagatggatacccgtttatgccagtgccatgactgaaaccctgcttgtccaacttgaaatatcttcaatgcccatctattcttccttgatcttgttttttcctgtgataatacaatagtttttaccagttaatcagttaagatgaggcttaccaaatatatgggagtactactgaacac

SEQ ID NO: 240 - DNA, 1431 bp, synthetic construct
  misc_feature 1..1431: note = Synthetic construct
  source 1..1431: mol_type = other DNA
aataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggcttctattgtttatttcttgcgtttttgttgcatttcgttgcagatttaagagataaacagtggaaggcgctttcaagtcgtccggtcattaattaagccttattgtggctagaggttcaggggcggtatatcgcgccaaccaaactccttgttctattcccagagacagtagctgttagcggtttggtgtggctcttccagactgatttttttttcccaactcgattgcgaatccaaacacagtttatgtggtgaagagacaaggttccttctcctatggagcttttttcttttgagatggagtctcactttgtcacccaggctggagtgcagtggctcaatctcggctcactacaacctccgcctcccgggttcaagcgattctcctgcctcagcctgcggagtacctgggactacaggcgcccgccaccacacccgactaatttttgtatttttagtagagacagggtttcaccgtgttggtgaggatggtatcgatctcctgacctcgtgatccgcctgcctcagcctcccaaagtgctgggattacaggtgtgagccaccacacctggcccttttctttctttctttcttttttttgttttttgtttgtttgtttgtttgtttgtttgtttttgagagggagtttcgctcttgttgcccaggctggagtgcagtggcgcgatctcggctcactgcaacctccacctcccgggttcaagcgattctcctcctcagcatctgggattacaggcgcaccaccacgcccggctaatttttgtgtttttagtagagacagagtttcaccatgttggccaggctggtatcaaactcctgaccccaggtaatccgcctgcctcggccttccaaagtgttgggattacaggcaaaagccaacgtgcccggcccctatggagcttttctaatagaaccaaacacaaaacaaattgaataaataatataaatcccagataaataatatctcagtgagaagtgccctgtagaaagagcattttgatagaatggtctacctccttcctattccctctccataagggagctcacctacttccatggctttaagtaaatgccatctgatagctagtgaccccccagtttacagccatcagctagtcctgttgactcccttccatcagctggtcctgttgataccttcaaagcgtacgcttcatccaaccacattttaccacctccactgctgccatcctggtccaagatctcttgctggataattgcaatagcccctaact

SEQ ID NO: 241 - DNA, 1186 bp, Homo sapiens
  source 1..1186: mol_type = genomic DNA
ctcttgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 242 - DNA, 714 bp, synthetic construct
  misc_feature 1..714: note = blue fluorescent protein
  source 1..714: mol_type = other DNA
atggtgtcaaaaggtgaagaactaattaaggaaaatatgcatatgaagttgtacatggaaggtactgttgacaaccaccacttcaagtgtacctctgagggagaaggaaaaccctatgagggaactcaaaccatgagaatcaaggttgttgaagggggacctcttccttttgcctttgacatcttggctacctctttcttatatgggtccaagaccttcatcaaccacacccaaggtatcccagacttcttcaaacaatcctttccagagggttttacctgggaaagggttaccacctatgaggatggaggtgtgttgactgctacccaagacacctctcttcaagatggatgtttgatctacaatgttaagatcagaggtgtcaattttacctctaatggaccagtcatgcaaaaaaaaaccctagggtgggaagccttcacagaaaccttgtaccctgcagatggtggtttggaaggtagaaatgacatggctttgaagttggttggtggttctcacttgatagctaatgctaagactacttatagatctaaaaaaccagctaagaacttgaagatgccaggtgtttactatgttgactacagattggaaagaatcaaggaagctaacaatgaaacctatgttgaacaacatgaagttgctgttgctagatactgtgacctaccatctaagttgggtcacaaactaaactga

SEQ ID NO: 243 - DNA, 318 bp, synthetic construct
  misc_feature 1..318: note = polyA sequence
  source 1..318: mol_type = other DNA
aataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgacagtgcctctatctggaggccaggtagggctggccttgggggagggggaggccagaatgactccaagagctacaggaaggcaggtcagaggccccactggacaaacagtggctggactctgcaccataacacacaatcaacaggggagtgagctggtcaaa

SEQ ID NO: 244 - DNA, 318 bp, synthetic construct; identical to SEQ ID NO: 243
  misc_feature 1..318: note = loxP site
  source 1..318: mol_type = other DNA

SEQ ID NO: 245 - DNA, 1280 bp, Homo sapiens
  source 1..1280: mol_type = genomic DNA
ttttgtttatggtgtaagacaagggtctgatttcatttcattttgttttgtttatggtgtaagacaagggtctgatttcatttcattttgagggtttcaccctctcatataataaaattcttctatatacccttctatcatcacttattactgattatatgccttgatttcagaatcttgccaactagattcagaatttgactgggagagaggacaaggaccacttgagactcatattttatttccagaatctagcatctacctacctaggtattgaataagaaaaatgaagttaaggtggttgatggtaacactatgctaataactgcagagccagaagcaccataagggacatgataagggagccagcagacctctgatctcttcctgaatgctaatcttaaacatcctgaggaagaatgggacttccatttggggtgggcctatgacagggtaataagacagtagtgaatatcaagctacaaaaagccgcctttcaaattcttctcagtcctaacttttcatactaagcccagtccttccaaagcagactgtgaaagagtgatagttccgggagactagcactgcagattccgggtcactgtgagtgggggaggcagggaagaagggctcacaggacagtcaaaccatgacccctgtttttccttcttcaagtagacctctataagacaacagagacaactaaggctgagtggccaggcgaggagaaaccatctcgccgtaaaacatggaaggaacacttcaggggaaaggtggtatctctaagcaagagaactgagtggagtcaaggctgagagatgcaggataagcaaatgggtagtgaaaagacattcatgaggacagctaaaacaataagtaatgtaaaatacagcatagcaaaactttaacctccaaatcaagcctctacttgaatccttttctgagggatgaataaggcatatgcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagctta

SEQ ID NO: 246 - DNA, 834 bp, synthetic construct
  misc_feature 1..834: note = blue fluorescent protein
  source 1..834: mol_type = other DNA
tcacacattgatcctagcagaagcacaggctgcagggtgacggtccatcccgctctcctgggcacaagacatgggcagcgtgccatcatcctgctcctccacctccggcgggaagccatggctgtttagtttgtgacccaacttagatggtaggtcacagtatctagcaacagcaacttcatgttgttcaacataggtttcattgttagcttccttgattctttccaatctgtagtcaacatagtaaacacctggcatcttcaagttcttagctggttttttagatctataagtagtcttagcattagctatcaagtgagaaccaccaaccaacttcaaagccatgtcatttctaccttccaaaccaccatctgcagggtacaaggtttctgtgaaggcttcccaccctagggtttttttttgcatgactggtccattagaggtaaaattgacacctctgatcttaacattgtagatcaaacatccatcttgaagagaggtgtcttgggtagcagtcaacacacctccatcctcataggtggtaaccctttcccaggtaaaaccctctggaaaggattgtttgaagaagtctgggataccttgggtgtggttgatgaaggtcttggacccatataagaaagaggtagccaagatgtcaaaggcaaaaggaagaggtcccccttcaacaaccttgattctcatggtttgagttccctcatagggttttccttctccctcagaggtacacttgaagtggtggttgtcaacagtaccttccatgtacaacttcatatgcatattttccttaattagttcttcaccttttgacaccat

SEQ ID NO: 247 - DNA, 1640 bp, Homo sapiens
  source 1..1640: mol_type = genomic DNA
caaccagcacgttgcccaggagctgtaggaaaaagaagaaggcatgaacatggttagcagaggctctagagccgccggtcacacgccagaagccgaaccccgccctgccccgtcccccccgaaggcagccgtccccctgcggcagccccgaggctggagatggagaaggggacggcggcgcggcgacgcacgaaggccctccccgcccatttccttcctgccggcgccgcaccgcttcgcccgcgcccgctagagggggtgcggcggcgcctcccagatttcggctccgccagatttgggacaaaggaagtccctgcgccctctcgcacgattaccataaaaggcaatggctgcggctcgccgcgcctcgacagccgccggcgctccggggccgccgcgcccctcccccgagccctccccggcccgaggcggccccgccccgcccggcacccccacctgccgccaccccccgcccggcacggcgagccccgcgccacgccccgcacggagccccgcacccgaagccgggccgtgctcagcaactcggggaggggggtgcaggggggggttacagcccgaccgccgcgcccacaccccctgctcacccccccacgcacacaccccgcacgcagcctttgttcccctcgcagcccccccgcaccgcggggcaccgcccccggccgcgctcccctcgcgcacacgcggagcgcacaaagccccgcgccgcgcccgcagcgctcacagccgccgggcagcgcgggccgcacgcggcgctccccacgcacacacacacgcacgcaccccccgagccgctcccccccgcacaaagggccctcccggagccctttaaggctttcacgcagccacagaaaagaaacgagccgtcattaaaccaagcgctaattacagcccggaggagaagggccgtcccgcccgctcacctgtgggagtaacgcggtcagtcagagccggggcgggcggcgcgaggcggcgcggagcggggcacggggcgaaggcaacgcagcgactcccgcccgccgcgcgcttcgctttttatagggccgccgccgccgccgcctcgccataaaaggaaactttcggagcgcgccgctctgattggctgccgccgcacctctccgcctcgccccgccccgcccctcgccccgccccgccccgcctggcgcgcgcccccccccgcccccatcgctgcacaaaataattaaaaaataaataaatacaaaattgggggtggggaggggggggagatggggagagtgaagcagaacgtggggctcacctcgacccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccactcattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatga

SEQ ID NO: 248 - DNA, 2292 bp, synthetic construct
  misc_feature 1..2292: note = AAVS1LP1.0
  source 1..2292: mol_type = other DNA
ataacttcgtatagcatacattatacgaagttatctcttgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagccaccatggtgtcaaaaggtgaagaactaattaaggaaaatatgcatatgaagttgtacatggaaggtactgttgacaaccaccacttcaagtgtacctctgagggagaaggaaaaccctatgagggaactcaaaccatgagaatcaaggttgttgaagggggacctcttccttttgcctttgacatcttggctacctctttcttatatgggtccaagaccttcatcaaccacacccaaggtatcccagacttcttcaaacaatcctttccagagggttttacctgggaaagggttaccacctatgaggatggaggtgtgttgactgctacccaagacacctctcttcaagatggatgtttgatctacaatgttaagatcagaggtgtcaattttacctctaatggaccagtcatgcaaaaaaaaaccctagggtgggaagccttcacagaaaccttgtaccctgcagatggtggtttggaaggtagaaatgacatggctttgaagttggttggtggttctcacttgatagctaatgctaagactacttatagatctaaaaaaccagctaagaacttgaagatgccaggtgtttactatgttgactacagattggaaagaatcaaggaagctaacaatgaaacctatgttgaacaacatgaagttgctgttgctagatactgtgacctaccatctaagttgggtcacaaactaaactgaaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgacagtgcctctatctggaggccaggtagggctggccttgggggagggggaggccagaatgactccaagagctacaggaaggcaggtcagaggccccactggacaaacagtggctggactctgcaccataacacacaatcaacaggggagtgagctggtcaaaataacttcgtataggatactttatacgaagttat

SEQ ID NO: 249 - DNA, 7543 bp, synthetic construct
  misc_feature 1..7543: note = AAVS1LP2.0
  source 1..7543: mol_type = other DNA
gagaagctgcccaaagccacaggtagtgaaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctcttgaggccaagtgtgactttgtggtgtggctgggttgggggcagcagagggtgaaccctgcaggagggtgaaccctgcaaaagggtggggcagtgggggccaacttgtccttacccagagtgcaggtgtgtggagatccctcctgccttgacattgagcagccttagagggtgggggaggctcaggggtcaggttcctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtgggggtgtagtgggtgttcctagctgccacgcctttgccttcacctatgggatcgtggctgtcagccttgagggtcagcctggcccaggctcccataggcttaggagaggccgcaattcctacctgttcatccagacggagggggacctggaatcaaagtcaagttggggtagggggtccatggggccatatctggcctgcagacagctctggttagctatgggctgaggtctggattctgccttgtgactggagactgggcgccatcccgtggcctctgagggcccagtttgttcgtgacccatgctgcagagggagatacccaggctcctggacctcagggcctgcctggcactgcaggccaggttctctttttatttctgagcaggggtcttgtgttgcccaggctggagtgtaatggcacaaccatggctcactgcagcctcaactttgggctcaagcaattctcctgcctcagcctcccaagtagctgaaactacacaggcatgccccagcacgcccagctagttgcaggtcagattctcattgttctacagggccctgagttaaatactctcgcaagaagaaaccaagcctggcctgccttccctctgctagaagctgtgattgacaccagcagagaatgaaggaagaaaagggggtgaggatcccttgcagggatgccgcggggacagccccccccccaaagcccccagggatgtaattgcgtccctctcccgctagggggcagcagcgagccgcccggggctccgctccggcccgacgctccccccgcatccccgagccggagcccgcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaatggcctgggttggaaaggcccacaatgctcatccagttccaacccctgctatgtgcagggtcgccaaccagcagcccagactgcccagagccacatccagcctggccttgaatgcctgcagggatggggcatccacagcctccttgggcaacctgttcagtgcgtcaccaccctctgggggaaaaacttcctcctcatatccaacctaaacctcccctgtctcagtttaaagccattccctcctgtcctatcaagggggagtttgctgtgacattgttggtctggggtgacacatgtttgccaattcagtgcatcacggagaggcagatcttggggataaggaaaagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcaccacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagtaccgttcgtatagcatacattatacgaagttatttttgtttatggtgtaagacaagggtctgatttcatttcattttgttttgtttatggtgtaagacaagggtctgatttcatttcattttgagggtttcaccctctcatataataaaattcttctatatacccttctatcatcacttattactgattatatgccttgatttcagaatcttgccaactagattcagaatttgactgggagagaggacaaggaccacttgagactcatattttatttccagaatctagcatctacctacctaggtattgaataagaaaaatgaagttaaggtggttgatggtaacactatgctaataactgcagagccagaagcaccataagggacatgataagggagccagcagacctctgatctcttcctgaatgctaatcttaaacatcctgaggaagaatgggacttccatttggggtgggcctatgacagggtaataagacagtagtgaatatcaagctacaaaaagccgcctttcaaattcttctcagtcctaacttttcatactaagcccagtccttccaaagcagactgtgaaagagtgatagttccgggagactagcactgcagattccgggtcactgtgagtgggggaggcagggaagaagggctcacaggacagtcaaaccatgacccctgtttttccttcttcaagtagacctctataagacaacagagacaactaaggctgagtggccaggcgaggagaaaccatctcgccgtaaaacatggaaggaacacttcaggggaaaggtggtatctctaagcaagagaactgagtggagtcaaggctgagagatgcaggataagcaaatgggtagtgaaaagacattcatgaggacagctaaaacaataagtaatgtaaaatacagcatagcaaaactttaacctccaaatcaagcctctacttgaatccttttctgagggatgaataaggcatatgcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttatcacacattgatcctagcagaagcacaggctgcagggtgacggtccatcccgctctcctgggcacaagacatgggcagcgtgccatcatcctgctcctccacctccggcgggaagccatggctgtttagtttgtgacccaacttagatggtaggtcacagtatctagcaacagcaacttcatgttgttcaacataggtttcattgttagcttccttgattctttccaatctgtagtcaacatagtaaacacctggcatcttcaagttcttagctggttttttagatctataagtagtcttagcattagctatcaagtgagaaccaccaaccaacttcaaagccatgtcatttctaccttccaaaccaccatctgcagggtacaaggtttctgtgaaggcttcccaccctagggtttttttttgcatgactggtccattagaggtaaaattgacacctctgatcttaacattgtagatcaaacatccatcttgaagagaggtgtcttgggtagcagtcaacacacctccatcctcataggtggtaaccctttcccaggtaaaaccctctggaaaggattgtttgaagaagtctgggataccttgggtgtggttgatgaaggtcttggacccatataagaaagaggtagccaagatgtcaaaggcaaaaggaagaggtcccccttcaacaaccttgattctcatggtttgagttccctcatagggttttccttctccctcagaggtacacttgaagtggtggttgtcaacagtaccttccatgtacaacttcatatgcatattttccttaattagttcttcaccttttgacaccatggtggccaaccagcacgttgcccaggagctgtaggaaaaagaagaaggcatgaacatggttagcagaggctctagagccgccggtcacacgccagaagccgaaccccgccctgccccgtcccccccgaaggcagccgtccccctgcggcagccccgaggctggagatggagaaggggacggcggcgcggcgacgcacgaaggccctccccgcccatttccttcctgccggcgccgcaccgcttcgcccgcgcccgctagagggggtgcggcggcgcctcccagatttcggctccgccagatttgggacaaaggaagtccctgcgccctctcgcacgattaccataaaaggcaatggctgcggctcgccgcgcctcgacagccgccggcgctccggggccgccgcgcccctcccccgagccctccccggcccgaggcggccccgccccgcccggcacccccacctgccgccaccccccgcccggcacggcgagccccgcgccacgccccgcacggagccccgcacccgaagccgggccgtgctcagcaactcggggaggggggtgcaggggggggttacagcccgaccgccgcgcccacaccccctgctcacccccccacgcacacaccccgcacgcagcctttgttcccctcgcagcccccccgcaccgcggggcaccgcccccggccgcgctcccctcgcgcacacgcggagcgcacaaagccccgcgccgcgcccgcagcgctcacagccgccgggcagcgcgggccgcacgcggcgctccccacgcacacacacacgcacgcaccccccgagccgctcccccccgcacaaagggccctcccggagccctttaaggctttcacgcagccacagaaaagaaacgagccgtcattaaaccaagcgctaattacagcccggaggagaagggccgtcccgcccgctcacctgtgggagtaacgcggtcagtcagagccggggcgggcggcgcgaggcggcgcggagcggggcacggggcgaaggcaacgcagcgactcccgcccgccgcgcgcttcgctttttatagggccgccgccgccgccgcctcgccataaaaggaaactttcggagcgcgccgctctgattggctgccgccgcacctctccgcctcgccccgccccgcccctcgccccgccccgccccgcctggcgcgcgcccccccccgcccccatcgctgcacaaaataattaaaaaataaataaatacaaaattgggggtggggaggggggggagatggggagagtgaagcagaacgtggggctcacctcgacccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccactcattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaataacttcgtataggatactttatacgaagttatctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtggtgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaatgctgtgacttggagagtgtcccagagccctcaacacctgcatgtcccacgtccatgctgtcctgcttttccttatccccaagatctgcctctccgtgatgcactgaattggcaaacatgtgtcaccccagaccaacaatgtcacagcaaactcccccttgatgggacaggagggaatggctttaaactgagacaggggaggtttaggttggatatgaggaggaagtttttcccccagagggtggtgacgcactgaacaggttgcccaaggaggctgtggatgccccatccctgcaggcattcaaggccaggctggatgtggctctgggcagtctgggctgttggttggcgaccctgcacatagcaggggttggaactggatgagcattgtgggcctttccaacccaggccattctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgcgggctccggctcggggatgcggggggaagcgtcgggccggagcggagccccgggcggctcgctgctgccccctagcgggagagggacgcaattacatccctgggggctttggggggggctgtccccggagaagctgcccaaagccacagg

SEQ ID NO: 250 - DNA, 1647 bp, synthetic construct
  misc_feature 1..1647: note = Synthetic construct
  source 1..1647: mol_type = other DNA
tcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatcccccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttg

SEQ ID NO: 251 - protein, 8 aa, synthetic construct
  REGION 1..8: note = synthetic construct
MAPRTLIL

SEQ ID NO: 252 - protein, 8 aa, synthetic construct
  REGION 1..8: note = synthetic construct
MAPRTLFL

SEQ ID NO: 253 - DNA, 1179 bp, synthetic construct
  misc_feature 1..1179: note = CD46WT
  source 1..1179: mol_type = other DNA
atggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctga

SEQ ID NO: 254 - DNA, 1179 bp, synthetic construct
  misc_feature 1..1179: note = CD46LL
  source 1..1179: mol_type = other DNA
atggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcacttcatctgcaacgagggttactacctgattggtgaggagatcctgtattgtgaacttaaaggatcagtagcaatttggagcggtaagcccccaatatgtgagaaggtcttgtgtacaccacctccaaagatcaagaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctga

SEQ ID NO: 255 - DNA, 1179 bp, synthetic construct
  misc_feature 1..1179: note = CD46i
  source 1..1179: mol_type = other DNA
atggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcacttcatctgcaacgagggttactacctgattggtgaggagatcctgtattgtgaacttaaaggatcagtagcaatttggagcggtaagcccccaatatgtgagaaggtcttgtgtacaccacctccaaagatcaagaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctctga

SEQ ID NO: 256 - DNA, 1179 bp, synthetic construct
  misc_feature 1..1179: note = CD46da
  source 1..1179: mol_type = other DNA
atggagcctcccggccgccgcgagtgtccctttccttcctggcgctttcctgggttgcttctggcggccatggtgttgctgctgtactccttctccgatgcctgtgaggagccaccaacatttgaagctatggagctcatcggcaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtaccgatatcttcaaaggaggaagaagaaaggcacatacctaactgatgagacccacagagaagtaaaatttacttctctctga

SEQ ID NO: 257 - DNA, 1176 bp, synthetic construct
  misc_feature 1..1176: note = PL14P
  source 1..1176: mol_type = other DNA
atggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctc

SEQ ID NO: 258 - DNA, 1176 bp, synthetic construct
  misc_feature 1..1176: note = PL14Pv_LL
  source 1..1176: mol_type = other DNA
atggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcacttcatctgcaacgagggttactacctgattggtgaggagatcctgtattgtgaacttaaaggatcagtagcaatttggagcggtaagcccccaatatgtgagaaggtcttgtgtacaccacctccaaagatcaagaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctc

SEQ ID NO: 259 - DNA, 972 bp, synthetic construct
  misc_feature 1..972: note = CD47 isoform 1
  source 1..972: mol_type = other DNA
atgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataa

SEQ ID NO: 260 - DNA, 27 bp, synthetic construct
  misc_feature 1..27: note = HLA-C epitope
  source 1..27: mol_type = other DNA
gttatggctccgcggactttaatttta

SEQ ID NO: 261 - DNA, 27 bp, synthetic construct
  misc_feature 1..27: note = HLA-G epitope
  source 1..27: mol_type = other DNA
gtcatggcgccccgaaccctcttcctg

SEQ ID NO: 262 - protein, 392 aa, synthetic construct [sequence omitted]

SEQ ID NO: 263 - protein, 377 aa, synthetic construct
  REGION 1..377: note = hsCD46BC1
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGPRPTYKPPVSNYPGYPKPEEGILDSLDVWVIAVIVIAIVVGVAVICVVPYRYLQRRKKKGTYLTDETHREVKFTSL

SEQ ID NO: 264 - protein, 384 aa, synthetic construct
  REGION 1..384: note = hsCD46BC2
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGPRPTYKPPVSNYPGYPKPEEGILDSLDVWVIAVIVIAIVVGVAVICVVPYRYLQRRKKKGKADGGAEYATYQTKSTTPAEQRG

SEQ ID NO: 265 - DNA, 1728 bp, synthetic construct
  misc_feature 1..1728: note = THBDWT
  source 1..1728: mol_type = other DNA
atgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctga

SEQ ID NO: 266 - DNA, 1728 bp, synthetic construct; identical to SEQ ID NO: 166
  misc_feature 1..1728: note = THBDda
  source 1..1728: mol_type = other DNA

The invention claimed is:

1. A genetically modified porcine cell comprising a nucleic acid molecule, wherein the nucleic acid molecule comprises:
   (a) a first polycistronic cassette comprising: (i) an endothelial protein C receptor (EPCR) transgene and (ii) a thrombomodulin (THBD) transgene;
   (b) a second polycistronic cassette comprising: (i) a tumor necrosis factor a-induced protein 3 (A20) transgene and (ii) a heme oxygenase-1 (HO1) transgene; and
   (c) a third polycistronic cassette comprising: (i) a cluster of differentiation 46 (CD46) transgene, (ii) a CD55 transgene, and (iii) a CD47 transgene,
   wherein the nucleic acid molecule is integrated at a single genomic locus.

2. The genetically modified porcine cell of claim 1, wherein:
   (a) the EPCR transgene comprises a nucleic acid sequence having at least 80% identity to any one of SEQ ID NOS: 92, 93, or 181;
   (b) the THBD transgene comprises a nucleic acid sequence having at least 80% identity to any one of SEQ ID NOS: 97-102, 166, or 265-266;
   (c) the A20 transgene comprises a nucleic acid sequence having at least 80% identity to any one of SEQ ID NOS: 64-65, 104, 182, or 188;
   (d) the HO1 transgene comprises a nucleic acid sequence having at least 80% identity to any one of SEQ ID NOS: 63, 109, 165, 183, or 189;
   (e) the CD46 transgene comprises a nucleic acid sequence having at least 80% identity to any one of SEQ ID NOS: 71-76, 185, 200, or 253-258;
   (f) the CD55 transgene comprises a nucleic acid sequence having at least 80% identity to any one of SEQ ID NOS: 84, 85, 107, or 184; and
   (g) the CD47 transgene comprises a nucleic acid sequence having at least 80% identity to any one of SEQ ID NOS: 77-83, 180, or 259.

3. The genetically modified porcine cell of claim 2, wherein:
   (a) the EPCR transgene comprises a nucleic acid sequence having at least 90% identity to any one of SEQ ID NOS: 92, 93, or 181;
   (b) the THBD transgene comprises a nucleic acid sequence having at least 90% identity to any one of SEQ ID NOS: 97-102, 166, or 265-266;

(c) the A20 transgene comprises a nucleic acid sequence having at least 90% identity to any one of SEQ ID NOS: 64-65, 104, 182, or 188;
   (d) the HO1 transgene comprises a nucleic acid sequence having at least 90% identity to any one of SEQ ID NOS: 63, 109, 165, 183, or 189;
   (e) the CD46 transgene comprises a nucleic acid sequence having at least 90% identity to any one of SEQ ID NOS: 71-76, 185, 200, or 253-258;
   (f) the CD55 transgene comprises a nucleic acid sequence having at least 90% identity to any one of SEQ ID NOS: 84, 85, 107, or 184; and
   (g) the CD47 transgene comprises a nucleic acid sequence having at least 90% identity to any one of SEQ ID NOS: 77-83, 180, or 259.

4. The genetically modified porcine cell of claim 3, wherein:
   (a) the EPCR transgene comprises a nucleic acid sequence having at least 95% identity to any one of SEQ ID NOS: 92, 93, or 181;
   (b) the THBD transgene comprises a nucleic acid sequence having at least 95% identity to any one of SEQ ID NOS: 97-102, 166, or 265-266;
   (c) the A20 transgene comprises a nucleic acid sequence having at least 95% identity to any one of SEQ ID NOS: 64-65, 104, 182, or 188;
   (d) the HO1 transgene comprises a nucleic acid sequence having at least 95% identity to any one of SEQ ID NOS: 63, 109, 165, 183, or 189;
   (e) the CD46 transgene comprises a nucleic acid sequence having at least 95% identity to any one of SEQ ID NOS: 71-76, 185, 200, or 253-258;
   (f) the CD55 transgene comprises a nucleic acid sequence having at least 95% identity to any one of SEQ ID NOS: 84, 85, 107, or 184; and
   (g) the CD47 transgene comprises a nucleic acid sequence having at least 95% identity to any one of SEQ ID NOS: 77-83, 180, or 259.

5. The genetically modified porcine cell of claim 4, wherein:
   (a) the EPCR transgene comprises any one of SEQ ID NOS: 92, 93, or 181;
   (b) the THBD transgene comprises any one of SEQ ID NOS: 97-102, 166, or 265-266;
   (c) the A20 transgene comprises any one of SEQ ID NOS: 64-65, 104, 182, or 188;

(d) the HO1 transgene comprises any one of SEQ ID NOS: 63, 109, 165, 183, or 189;

(e) the CD46 transgene comprises any one of SEQ ID NOS: 71-76, 185, 200, or 253-258;

(f) the CD55 transgene comprises any one of SEQ ID NOS: 84, 85, 107, or 184; and (g) the CD47 transgene comprises any one of SEQ ID NOS: 77-83, 180, or 259.

6. The genetically modified porcine cell of claim 1, wherein the nucleic acid molecule comprises a sequence having at least 80% identity to SEQ ID NO: 30.

7. The genetically modified porcine cell of claim 6, wherein the nucleic acid molecule comprises a sequence having at least 90% identity to SEQ ID NO: 30.

8. The genetically modified porcine cell of claim 7, wherein the nucleic acid molecule comprises a sequence having at least 95% identity to SEQ ID NO: 30.

9. The genetically modified porcine cell of claim 8, wherein the nucleic acid molecule comprises a sequence having at least 98% identity to SEQ ID NO: 30.

10. The genetically modified porcine cell of claim 9, wherein the nucleic acid molecule comprises a sequence having at least 99% identity to SEQ ID NO: 30.

11. The genetically modified porcine cell of claim 10, wherein the nucleic acid molecule comprises SEQ ID NO: 30.

12. A genetically modified porcine cell comprising a nucleic acid molecule, wherein the nucleic acid molecule comprises:

(a) a first polycistronic cassette comprising: (i) a tissue factor pathway inhibitor (TFPI) transgene, (ii) an endothelial protein C receptor (EPCR) transgene, and (iii) a thrombomodulin (THBD) transgene;

(b) a second polycistronic cassette comprising: (i) (A) a beta 2 microglobulin (B2M) transgene and a human leukocyte antigen E (HLA-E) transgene, or (B) a transgene encoding a B2M-HLA-E fusion; and (ii) a cluster of differentiation 47 (CD47) transgene; and (c) a third polycistronic cassette comprising: (i) a CD46 transgene and (ii) a CD55 transgene, wherein the nucleic acid molecule is integrated at a single genomic locus.

13. The genetically modified porcine cell of claim 12, wherein the second polycistronic cassette comprises the transgene encoding the B2M-HLA-E fusion, and wherein:

(a) the TFPI transgene comprises a nucleic acid sequence having at least 80% identity to any one of SEQ ID NOS: 94-96, 103, or 187;

(b) the EPCR transgene comprises a nucleic acid sequence having at least 80% identity to any one of SEQ ID NOS: 92, 93, or 181;

(c) the THBD transgene comprises a nucleic acid sequence having at least 80% identity to any one of SEQ ID NOS: 97-102, 166, or 265-266;

(d) the transgene encoding the B2M-HLA-E fusion comprises a nucleic acid sequence having at least 80% identity to any one of SEQ ID NOS: 62, 66, or 105;

(e) the CD47 transgene comprises a nucleic acid sequence having at least 80% identity to any one of SEQ ID NOs: SEQ ID NOS: 77-83, 180, or 259;

(f) the CD46 transgene comprises a nucleic acid sequence having at least 80% identity to any one of SEQ ID NOS: 71-76, 185, 200, or 253-258; and (g) the CD55 transgene comprises a nucleic acid sequence having at least 80% identity to any one of SEQ ID NOS: 84, 85, 107, or 184.

14. The genetically modified porcine cell of claim 13, wherein:

(a) the TFPI transgene comprises a nucleic acid sequence having at least 90% identity to any one of SEQ ID NOS: 94-96, 103, or 187;

(b) the EPCR transgene comprises a nucleic acid sequence having at least 90% identity to any one of SEQ ID NOS: 92, 93, or 181;

(c) the THBD transgene comprises a nucleic acid sequence having at least 90% identity to any one of SEQ ID NOS: 97-102, 166, or 265-266;

(d) the transgene encoding the B2M-HLA-E fusion comprises a nucleic acid sequence having at least 90% identity to any one of SEQ ID NOS: 62, 66, or 105;

(e) the CD47 transgene comprises a nucleic acid sequence having at least 90% identity to any one of SEQ ID NOS: SEQ ID NOs: 77-83, 180, or 259;

(f) the CD46 transgene comprises a nucleic acid sequence having at least 90% identity to any one of SEQ ID NOS: 71-76, 185, 200, or 253-258; and (g) the CD55 transgene comprises a nucleic acid sequence having at least 90% identity to any one of SEQ ID NOS: 84, 85, 107, or 184.

15. The genetically modified porcine cell of claim 14, wherein:

(a) the TFPI transgene comprises a nucleic acid sequence having at least 95% identity to any one of SEQ ID NOS: 94-96, 103, or 187;

(b) the EPCR transgene comprises a nucleic acid sequence having at least 95% identity to any one of SEQ ID NOS: 92, 93, or 181;

(c) the THBD transgene comprises a nucleic acid sequence having at least 95% identity to any one of SEQ ID NOS: 97-102, 166, or 265-266;

(d) the transgene encoding the B2M-HLA-E fusion comprises a nucleic acid sequence having at least 95% identity to any one of SEQ ID NOS: 62, 66, or 105;

(e) the CD47 transgene comprises a nucleic acid sequence having at least 95% identity to any one of SEQ ID NOS: SEQ ID NOs: 77-83, 180, or 259;

(f) the CD46 transgene comprises a nucleic acid sequence having at least 95% identity to any one of SEQ ID NOS: 71-76, 185, 200, or 253-258; and (g) the CD55 transgene comprises a nucleic acid sequence having at least 95% identity to any one of SEQ ID NOS: 84, 85, 107, or 184.

16. The genetically modified porcine cell of claim 15, wherein:

(a) the TFPI transgene comprises any one of SEQ ID NOS: 94-96, 103, or 187;

(b) the EPCR transgene comprises any one of SEQ ID NOS: 92, 93, or 181;

(c) the THBD transgene comprises any one of SEQ ID NOS: 97-102, 166, or 265-266;

(d) the transgene encoding the B2M-HLA-E fusion comprises any one of SEQ ID NOS: 62, 66, or 105;

(e) the CD47 transgene comprises any one of SEQ ID NOS: SEQ ID NOs: 77-83, 180, or 259;

(f) the CD46 transgene comprises any one of SEQ ID NOS: 71-76, 185, 200, or 253-258; and (g) the CD55 transgene comprises any one of SEQ ID NOS: 84, 85, 107, or 184.

17. The genetically modified porcine cell of claim 12, wherein the nucleic acid molecule comprises a sequence having at least 80% identity to SEQ ID NO: 31.

18. The genetically modified porcine cell of claim 17, wherein the nucleic acid molecule comprises a sequence having at least 90% identity to SEQ ID NO: 31.

19. The genetically modified porcine cell of claim 18, wherein the nucleic acid molecule comprises a sequence having at least 95% identity to SEQ ID NO: 31.

20. The genetically modified porcine cell of claim 19, wherein the nucleic acid molecule comprises a sequence having at least 98% identity to SEQ ID NO: 31.

21. The genetically modified porcine cell of claim 20, wherein the nucleic acid molecule comprises a sequence having at least 99% identity to SEQ ID NO: 31.

22. The genetically modified porcine cell of claim 21, wherein the nucleic acid molecule comprises SEQ ID NO: 31.

23. The genetically modified porcine cell of claim 2 or 13, wherein:

(a) the first polycistronic cassette comprises a first promoter, wherein the first promoter comprises a sequence having at least 80% identity to any one of SEQ ID NOS: 126-145, 167-168, 178-179, 231-238, or 250;

(b) the second polycistronic cassette comprises a second promoter, wherein the second promoter comprises a sequence having at least 80% identity to any one of SEQ ID NOS: 126-145, 167-168, 178-179, 231-238, or 250; and (c) the third polycistronic cassette comprises a third promoter, wherein the third promoter comprises a sequence having at least 80% identity to any one of SEQ ID NOS: 126-145, 167-168, 178-179, 231-238, or 250.

24. The genetically modified porcine cell of claim 23, wherein:

(a) the first promoter comprises any one of SEQ ID NOS: 126-145, 167-168, 178-179, 231-238, or 250;

(b) the second promoter comprises any one of SEQ ID NOS: 126-145, 167-168, 178-179, 231-238, or 250; and (c) the third promoter comprises any one of SEQ ID NOS: 126-145, 167-168, 178-179, 231-238, or 250.

25. The genetically modified porcine cell of claim 2 or 13, wherein:

(a) the first polycistronic cassette comprises a first poly A sequence having at least 80% identity to any one of SEQ ID NOS: 112-125, 154-156, 159-162, 190-192, or 239-240;

(b) the second polycistronic cassette comprises a second poly A sequence having at least 80% identity to any one of SEQ ID NOS: 112-125, 154-156, 159-162, 190-192, or 239-240; and (c) the third polycistronic cassette comprises a third poly A sequence having at least 80% identity to any one of SEQ ID NOS: 112-125, 154-156, 159-162, 190-192, or 239-240.

26. The genetically modified porcine cell of claim 25, wherein:

(a) the first poly A sequence comprises any one of SEQ ID NOS: 112-125, 154-156, 159-162, 190-192, or 239-240;

(b) the second poly A sequence comprises any one of SEQ ID NOS: 112-125, 154-156, 159-162, 190-192, or 239-240; and (c) the third poly A sequence comprises any one of SEQ ID NOS: 112-125, 154-156, 159-162, 190-192, or 239-240.

27. The genetically modified porcine cell of claim 2 or 13, wherein the CD46 transgene or the THBD transgene comprises a splice site mutation.

28. The genetically modified porcine cell of claim 2 or 13, wherein the nucleic acid molecule further comprises a nucleic acid sequence encoding a 2A peptide.

29. The genetically modified porcine cell of claim 28, wherein the 2A peptide is selected from the group consisting of E2A, T2A, F2A, and P2A.

30. The genetically modified porcine cell of claim 2 or 13, wherein the nucleic acid molecule further comprises an IRES sequence.

31. The genetically modified porcine cell of claim 1 or 12, wherein the nucleic acid molecule is integrated into a genomic safe harbor locus in a genome of the genetically modified porcine cell.

32. The genetically modified porcine cell of claim 31, wherein the genomic safe harbor locus is Adeno-Associated Virus Integration Site 1 (AAVS1), CCR5, or Fos5.

33. The genetically modified porcine cell of claim 1 or 12, wherein at least one polycistronic cassette of the nucleic acid molecule is a bicistronic cassette.

34. The genetically modified porcine cell of claim 1 or 12, wherein the genetically modified porcine cell lacks expression of an endogenous glycoprotein alpha-1,3-galactosyl-transferase (GGTA1) gene, an endogenous $\beta$-1,4-N-acetyl-galactosaminyltransferase 2 ($\beta$4GALNT2) gene, and an endogenous cytidine monophosphate-N-acetylneuraminic acid hydroxylase (CMAH) gene.

35. The genetically modified porcine cell of claim 1 or 12, wherein each transgene is a human transgene.

36. A genetically modified organ comprising the genetically modified porcine cell of claim 1 or 12.

37. The genetically modified organ of claim 36, wherein the genetically modified organ is a liver, a heart, or a kidney.

38. A genetically modified pig comprising the genetically modified porcine cell of claim 1 or 12.

39. The genetically modified pig of claim 38, wherein the genetically modified pig is a genetically modified Yucatan pig or a genetically modified Yorkshire pig.

* * * * *